United States Patent 10,221,454 (METHODS AND COMPOSITIONS FOR SCREENING AND TREATING DEVELOPMENTAL DISORDERS) - sequence listing, part 14

SEQ ID NO: 119 - DNA, 2057697 bp, Homo sapiens
cgaggcgtgacctagttgacaggctctgaggtgctgctgtggcggcgtccgcggggctgaggcgggtgggagccggagccgagcgcgggctgagggaggagggcggcgactggagagcggcgagcggcgagcagcgcaggacgcagagcctctttcactttttccctgctgagtgccccctcccacccctcccactccacacacaccctgtttgcccgtgagcctggggaacttgcagcttaaagccagccacccccacggcaacatgtaccccagcaacaagaagaaaaaggtgtggagagaggagaaaggtaaccggcccgtcgagtcctgggggtgcgggcggtgggggttagggtgggggcgggggtcaggctgtgtgtgccgcggcgccctccgcccgagctcccgcctcgcgccctcccggccggtgccgcctccctccggtgtccgtgtgtacacacgcgcacactcgcgcgcactccggcgtgcacgcgccgcccctgggcacctgcagctcgcgcacgtgtgggcgcacgcccctctctgttgccctcggcaccccgtcaccttctcccgaggcggtgctgcgttcgcctcgcttgcggcggggacccccaggcggcagccccgggcgcggcacaagttcctctgcaccgcagctgggacttgggcactgccggcctgggtgtcccgcggacaggtgcccgtcggcgggcgctcaggctgcagctgccgctgtgcctccgcgctccgtgcaccctcatttctttccttctcgcccctgtccccccagcccccgaatggcaaagcgtacccaccatcgggtgtttaccccttgtctaggtttccttccttcgctgccgcagcgtgacttttgaaacctggaactctaggggagccctaaaacgagcgtgttgtccgtgaggataagtgccttcagagaagtctgaatgggctgttctcccaacagtgtgtttctctgtattccatccccattcatgggctgaagttgctcagagtaagattttgtgactaatgtcactctgtatgaacccatctctgaattttgtgcgtataaggtttatctaaatcagctagattgacagtggcactgattctttaagaaacacaagtgtacgatccagcgtctcccaccaagatctcccgcttatcccatcacagtttggtaatattctaacttgagtgtctctggcgtttttcaccctccttttcacacctctttccttttcattctttagctatttacagaaatgtagcaaaaacttcttgcactcctattgctaaaataaactaaaacctgtatagcaagggtgaggtctattgagggtagtgcgcatttctcctggtacctcatctttacaaaaggatataggggtgactaggtatcaagttgatttccttgttaatagttcgttaaaacctgtagatttttattgcaagtcccggcctttatgaacacgaaggcaaaacagtggaggtaagaaagggaattaatgtggaaaaagaatccactatataggatcggcttccacaatgcacgaacaaaggcgtgaggagggaattttttttttcaaatttactgcaggaagatttaataatagaaccgaacaacacaattaaaatgatctttaaaaatgttgaaagtttagtcatttaattatgttttaataattatgggtttatagagagctaacacttctggtgttataaatcaaatgctgtcgagagtaatagcctgatagataaagtagtgtaaaataattttgctttgtttttttcagtagtagttactttagtttcaacacactttcaacaaggatttgccttgtgagcactgaaaaatcatttatgcccatgtttattgatgatgctgaaatgttcgctttgtataattgatgataatgagggcaaaacagtggaagacatagacattgttttcagtaacatgaatcattgatgaaattatagtgagtacttaagaactatttttctgtcataatagaaaaacagtgttcctcaagtaataacgttataatgtttccttcatttaacatctacacagttggactgtgaccagcaggcattttagaatcttttttaatgtcttgatttcttttcttctaataatggagaatatataaccaattttttttcctaaggaagcaaatgcaccattaaataaggcaattaacaagtaattatccaaaactaagttatttttgcatgaagtttaatgttaaaggaaaacgttactgcgatacgaagactttaatgcatatctcagtgtttctttttttcaggatgtctatgtttggaatatttaaatataaaatatatattatacccccaaggaagagctaaggatttctagtaccatagttagtattagagaagctgatgggatgcatgacctttttcctttcagcccactgggaagctgatggtatagtatttttgcagctgtcctttaaagctaaaggaaggcttacctacctcattgaaatgtcaaggcattctataaacatatttttaactcagtataccatttaataaataggtctgcctacttaattgcttggttcacagagaaaggactcattgtaaaggtgaagcattctttaaataaaagttttatgaaatgacaaagaaaatgcatatatatttgtggcctccagtatgtttcattgtttaaacaagtaattaaggagttctgaagaccacatatgtttaaataaacatgtttgatctagtattttgagtcctaattcagaaccactaatgtgcattttcaagtattgcaacttatttcattgttttgttttaaattgatctcgtttttaagtgttcacacttcaacttttaaataactggaacaacagaggccaggttgcatttctgtatgtaccttttgacattcacaaaaactgtcagttgcttcataatgtcttttaacctgctcagtaatattgtaataattttttatttgtgatctgagcttttttagcactgctttggcatactgctaatcatctcccttttctgcctttatgtgataattctaaatttaccattcccttcaagtttcctgttctctcaagaccctatcccccatactaaagagatgacattgcctttttaattcacagagaagggctaggcgcggtggctcacacctgtaatcccagcactttgggaggctgaggcgggtggatcatgaggtcaggagattgagaccatcctggggaacacggtgaaaccccgtctttactaaaaatacaaaaaattagccggtcgtggtggcacacgcctgtaatcccagctactcgggaggctgaggcaggagaaacgcttgaatccaggtgggagaggttggagtgagctaagatcgcgccactgcactacagcctgaatgacagagcaagactccgtctcaaaaaaaaaaaaaaaaaaattcacagagaaaataaatgccatgtaatatgaacagccctaacatcctcttgcatagtctcattggtctgttcctttacatgtccttttgactttgttctatcttagaggaaggacttttcttccttgtgtgtaagatgaatctttctgctgtgctctttatcccatatcttctttgagttcttgcaccatcatgtattctttcttgggtatgtttaatttcttggtgtcttcaggttcctctccattgcctgtaacagtgctcggatctcttccaccttagagtcacttttctttcatagggcttcacgtgaacttggagttgctgttctcactttccttcttttgctcagtccttcattgtcttctggatttccgttatattctaatgaaactaatgttcctgaagtcattcagtagtaacagtcatgatagtattcatgtaagaatagttaatatttaagccccatttgtatgctcagtactattcttagtagcttacatggattatctcatttaattctcacaacaaccctatgaggtaggaaactatatgaggcgaaatattgtgaggttaagagctttgaataccagttgcctgggtttgagtcctacttatactgcttaactagctgtggtactttaggtaagttatttgacgttgtttatagtttccttatctataagttgggaataatacctgcctacttacctcgaagggaaactgaaacataaagaggttaagtaacctacagatttgcaccatttagattacaactcaaacagctctgttaaccacttttcctctttattccatgctgttggtaaccacattgataaaagcaggttaatggctaagtaattttcactttttctgaccttcctgtagcagtctgtggtatttcccttagtgcacctgtagtcccagctactcaggaggctgaggcaggagaatcgcttgaacccaggaggcggaggttgcagtgagctgatatcgcgctactgcactccagcctggtgacagagcaagactctgtctcaagaaaaaaacaactctgttttctgaatgtttccttgtaccaggaacttgcacccatggtgacaactacgatttatttcattgttttcctatttgtgcccacttcctaaatactgtgttttgaggtttgatgcttccttccgttccctcttctttttcctttaggactagaattttaggttatattttctaaagtctctaggctagaccactctttaaatttccagattcttgatttcaacttcttcaatgtcctataggtaccttaaactcaatttttgtgaatatgtcacctctgattaagataccttttttttttgtctcctaatgtggctgaagttctagttataggagtgggaaaaatattggttccccattttctgttcacttgtgcttacattaatacttctgtagtttatttctgtgaaatagtcttttaaagtggttattttttgaaggttagattaccttaaactagatactaactatccctgcatccatttatctaaactgcagtaccttgtgatacactgaaagagaattgcagagtatgagaaataactgtctctctctctcactctctacatcgtggagaccattggtatggtatgggagacatgaaagctgacatacagagtgaagaagccagtgtcagtttatacattgaatattggtaaatatttcttccttgtttaggtgaaaaacgaatgtaaatagaattatttgcatgttttcctgtgtcctagtgggttgttttatacaccctctgggaaatgcataatcaactttcaatattagtagtctataggataaaggttaaactgctcactatggcatacaagtccctgtacagttttgttttacttttgtttccggctacttttcacttctgtggccattcctcttctcataccatatcttgcagcttcatttagttatagtattcatacctcctttgtttacattgttttgttagtctgaaatgttctttttacctcttcatgcaaaattcttcctgtcctttgtgaagcagcatacatattacctttttcggggagttttcctgagaatgtagtgtagtacagtggaataaataacatagggtgtagtctttgattaatggagatgtttgtctgaattttaattttggctcacttcctgaaacctctcttgctttgggcaaactactttgctgtgcttcatttccctatctgcaaaattggcataataatactatcaattttatgagttattaggaagattattttaatgagatatacatgtgaagtacctggccatagtgagttctttataaatgacatccactctaattctaagatgcaatttgtaaaatattttcattttatcgtcaagatatatatatttaaagcaattcttatatcatctacacaaagctgtaagtaaattgatagtgcagttgaggaaatatcttggtggttgcctttttttgtgctcttactatttgtacatacctgtcttagcattttatttatatagatactattttgtatcttactgtgttagactgttcttgcagttgctgtaaagaaatgcctaagactgagtaatttattaaaaaaaagacgtttaatagactcatggttctgcaggcaacacaaggatagcattggcatctgttaggtcttctgggaggcctcagggagcttttacttacagggcaagatgaagcggagggagcttttacttacggggcaagatgaagtaggagcaggcacttcacgtggcaagaacagtagcacgagagggttggggggaagtgccacacactttcaaacaaccagatctcacgaaaactcactatcttgaggctagcaccaggccatgagggatctgctcccatgacccaattacctcccactagacaccatgtcacacattggggattacatttcaacataagatttcaggggatatatatccaaaccatatcacttatccagcatatcacctggcccatagtaaactgtagatgttgcttgaaagtgtaaatgagtttacttatttcttggactatcataagagagtcttcatcaggctttgatttttttctcccctggtaatatgaaatttaacattttttaacatttaaatatggagtcactggatttgcattgtgttcttcaggactgtatcaactcttttgttagcttaacttggttaatacttaaagtataaaaataattcccatgtttaaacgttaaatacaaatggagattctgcttttattttgcaagaacgtttattgaagatgaccttagaagagagacgcaaagaatacctaagagactatattcccctgaacagcattctatcatggaaggaggagatgaagggcaagggccaaaatgatggtaagtttctcggaacattttttaggtagatatttttcccattttaggacaattgttgacagaaatgaataactggcgttcaataaagagattactattttgctatttgaaattattgtttggttgtgatttaattgtttttagtaacctacggtgttttttaaacttaggaaagtatattaacataatttgtgttctgaaatataccacatttataatatggtactttttttacaggtccttttttattttttctattctgtaacagttcttggagcaaatgctattagagatttgctgctttggtggtgtggccctttgagtttgctttaagttcatttataatcgattatcttatgttatttttaggattggggatacagctgaaagagagagtatattaggaaaaatagaaaaaccaaagaacatttctcattattttagagaatatattttgtatgatgtgttattatgtctgtatgtaaagtatttgtatgacagaatttactctcaaagtctttatgatttggtgggaatctagattatgttagaatataaaggaagttttaaggattaaaaaggtacgtgaaaaagtttctaaaaacaacataatagatttaatggatgtttaatatgcttgtctttgaattaacactcgttggtattaatgatctggatgtgaagtttagacaaacggtgcttcttaaggtgcttaacagttgagaaagactttatgaaatggacttgaaacatgctaatttcaaaggttgtggtcttagatcgatggaactacaccgggtactatgggcccagaataaagactagcatggaattcctatggataaaatctgaagggaaagattaggccttggtgtctgtgaagagaacacattgacctgaggatttgggttttagacacaactttgtttttctagaaaggcaaagcatgtgggattagcagtgaaaagctgtgggttcttttagaccttacgtagcctggaaacgtgtgaccttgggcaagcggggtagcagctctaccccacgttctaatggggtcattggacaagctgattgggatgtgcacatctgacctgtctgcccagtgtcttctgtaaatgcaagttgttttaagaatggtctgattccaaactgataagattggccttaagaagcccctgcctgatcacgtgagcatcatggaacccaaagatgatttgctgcccaccaccccgtctcagaacagaagggtgggaagccagagccacctgcattgccctagccagtccccacagtgtaacagggtctccttggcagctgtattctggagtctggttgttgctctgtaaagacctttaataaaatcttgtacaaaggttaaaaaaaaaaaaggtctggttaagacatcattgaaagagaggagagtgctgtgtaatgaaaagaatacagggctagaaatcaggagaacagaattctggtcctctgtcttacctaaggctatgtgcctcttcatgtttgagtctcagtaatttctttttttgtttataagcaactggtattgaatatttcagcagcagcactatcttcttcttttttttaaatggctacaggtcgagtatcccttatccaaaatgcacaggaccagaagtgtttggggttttggattgtttggattatacttgctggttcagcattcctaatccaaaatccaaaatgttccagtgagcatttcctttgagcattatgttggtgctcaaaaagtttcagattttggagcatttgggattttgaatttttgcattaggactactcaacctgtagtaaatgttccccaaattagaaaagaatacattgaatagaataacacctaacatagttatcctctaacaagatattgcatgtttaatcctgcctcccaatatgagctttataagtggttacaactgctctgtgtgtttcttattttcccccttatgctgttttaaacttgaaagtcctccatggggaacaaggtgatgtgatcaaaattatatttctatttttcctgaaatgttacttgcttctctctgttgtgacccagactctggtgaatggcctcttcctttttcatgaagtggaatggctcattttacaagtaatatttgtaaatatttatatacaatacacatttttcatatgactttttcttgtgttacctattcagtgctcagttattaaaaaatattagtcaagagagttttagtgttttaacagtttaaaaatcctttaaaaatataaatttacaaaaaataataaaggaaaactatacatatggttatatttgaaacgttttaagtcattgcttatacatgtataagtaggtattgatatttattaaatatgggattttaaactaagtattaaaagaattctataattccttgtcacttagtttctaattataggaaatgaacaatatttatcgggttagaacagtatatcagttttaaatttaatatcttatcattacttacgtttttatagaggaccatttttgcctaaatattcctgagtacttgaatagttcttgagctattgcttttaatttttttcttgctttgttcagatttattttactttaaccaaatgcttcttgttattataatacaatagaaagttaaataaaaaagaggggagcagccaaatatatttgtaacaatttggattttaagccttcttgaaacaaaaggaaacaaaatattgccaaggaacacaaaatcagtgtttatatggaaagggggaagcaagttttattttgacttacccctttggtaatattggaaagccatggattggaagaggaaagaatgggagatgattaccaaaaaataaaaataaaaaaacccaaaaaacaaaaaccccatccagaaaaacccattaaatacataatttgcttgctgtttatgttcatatttattaactgttgttagctaatttctagacttacatatttctaattcttcctctgtgttaccaattatgtaataattcaatatcatttgtcagttgctatgttgtggggattttaaaattcttgtctctcctattgtactgtctctagcacctggaatggtgccttatgggttggtggggcttaatcgtaagttaaataagaatgcctgaagagttaataatctacaagggacaattctttctccaaacttttttttttttttgagactgagtctcacttactttgtgccccgggctggagtgcagtggcgcgatgtgggctcactacaacctccacctcctggcttcaagcaattctcctgctgagctcctgagtagctgggattatagatgcgtgccaccacgcctgactaatttttgtattttttgtggagatgggctttcactgtgttggccaggctggtcttgaactcctgacctcaagtgatctgcccatgttggcctcctaaggtgctgggattacagacgtgagccactgcacctgcctctttttccaaacttttaatgagcatttataaatatatgtaaagctagaatacagtcatgtgccacaaaatgatgttttggtcattgacatcctgcatatatgatggtggtcccataagattataatactgtatttttactatgccttttctgtgtttacgtaggtttaaatacacaatgacttaccattgtgttatagttgcctacagtattctgtacagtaacatgctgtatgggttttagcctaggagcaattggctgtaccatataatctaggtgtgtatagactgtgtaccatctagatttttgtagtataccttacaatgtttgcacagcaatgaaatcacctaacaacgcctttctcagaacgtattccattgttaagcaatgcctgactgtagcaatgcatccattacccagtttcaacagttattacacggccaattttatttcatctataccagtgctccctataccttccccccagactattttgaatgaaatcacatatgtcatataaattttatctataaatgagtatctgtgtatatgcatatgtatgtatctctaaaagatggcatatttttgttgttttactaaaatactattattacctctcacatttaaaatttaacttaaaatttaattttgatataattaaatatccacttagtattcatgtttttcccattgtctcataaaggattttttcttttacaattgatttgcttgaatcaagatctaatcaaggtccatatattgcatttaattgatttgttccttaagtcacttttaatctatagttacctttctctgtccttttttccttcctcccttataatttatttgttgaatacactaggctgtcctgcagaattttttatattttgaattttgcttactgcatctctgtggtatcattgaacatgttcctctgtcccctttatttcttatgagttggtagttaaatccagaggtttgttcagagtggggtttaaatttttttgaaataatgctttatagattattgtacatctttttgcatcatatcacagggcacataatgcgtcattgtctccctcagtagtgataagattgatccctgggttcatgtattgtcagctgaatattgtcactaaactgtctggtgtaaagttctctgacaaccttttacctaatggttttagcagccattcgtgattattgcttagatccattacgttattaggggttgcaaaatagtggtatgtgaattttatcattccttatttatttgtcagacttctataaagaggaactttctgttattaagtcttttattatgcagtacggtttataaaggaaagcagaataaatgccatatttcccttatttactgattttcagattgagttcattccctaaaatcctccacaggtgaccaaagagtcctttttttaaaatttttgactatcattttcaatttgccccttccttctctcctcttctctgtctcttcctccctcttcctccctctcaacatgtatattaaatgagaatgtcccagtggttaacagtctacaaaggaggcatatacgtgtgtgtttgtgcatgcgcgtgcatgtatttatagctcccatataaaatacatagaattactaaacaataggcccaggatatggtagaaagacaaaggtagatatataaatgggtggatgggtagatatgatagaaagatggcattacttctttgttgagacaagagttctagttcttgggtttaatagttatgccttctgttaatctcctttcctactactgtgttaaggctccactagaataccacctagagaagcaatgttattgttacactttttggatggagtagtgttggcagagactctgccaggcttatgctaattttctctgactggttagtatcagggaaagcagctatggctataagtttagattgtctttttgagtaattacttttaatgtttatacagaacagcaataggggaaaaataaaataataatgaggatgagttaggtgaaaattataaaattatcttatactcaagtataaaatatttttaaaaattggtcatttaaagagccatctatgataataccatactgaatgggcaaaagctggaagcattccccttgaaaacgaacacaagacaaagatggcctctctcaccactcctattcaagatagtgttgggagttctgggcagggtaatcaggcaagagaatgaggtaaagcgtattcagctagaaagagaggaagtcaaactatttttgtttgtagatgacatgatcctacacgtagaaaaccccatcatctcagcccagtagcttttcaagctgataagcaacttcagcaaagtctcaggatacaaaataaatgcatacaaatctctagcattgctatacaccaaaaacaggcaggccgggaggcaagtcacaaatgagctctcattcacagttgccacaaaaagaataaaatacttaggaatgtggctaacaagggaagtgaaggatctcttcaaggagacctacaaaccactgctcaaggaaatcagagaggacacaaacagagaaacgttccgtgctcatagataggaagaatcaatattacaaaaatggtcatactgcccaaagcagggtatagattcagtactattcctattaaactactatcaacattcttcacagaattagaaaaaactactttaaaattcatatggaaccaaaaaagagcccaaatagccaagacagtcctaagcaaaaagaacaaagctagaggcatcacgctacctgacttcaaactatactacaaggccaaagtaaccaaaatggcatgggactggtacaagaacagacatagaccagtggaacagaatagaaaacccagaaataagtctgcacacctacaaccatgtgatctccgacaaacctggagatcacaaacaagcaatggagaaaggattctctatttaataaatggtgctgggaaaactgcctagtcatatgcagaaaattgaaactggaccccttccttacaccttatacacagattaactcaagatggattaaagattttaatgtaaaaccccaaactaaaaatcctggaagacaacatacgcagtaccattcaggatctaggcatgggcaaagatttcatgtgaagatgccaaaaacaattgcaacaaaagcaaaaattgacaaatgggatttaattacactagagtttctgcacagccaaagaaactctcagcatgaacagagaacctacagaatgggagaaaatttttataatctatccatctgacaaaggtcttatatccagcatctataaggaacttaaatttacaagaaaaaaccaaacaaccccattaaaaatagacaaaggacatgaacaggcacttctcaaaagaagacatacatgtggccaacaaacatatgacaaaaagctcaacattactcatcactaatgagtaatgatgcaaatgcaaatcaaaaccacaatgtgataccaactcacaccagtctgaatggctatcattaaaaagtcaaagaacaacagatgctggcgaggttatagaggaacactgatacactgttggtgggaatgtaaattagctcaaccattgtggaagacagtatgacaatgccttaaagacatagaggtaaaaataccgtttgacccagcaatcctattactgggtgtatacacccaaatgaatataaatcattctattataaagataataaaagaaggcgtatgttcattacagcactgttcacaatggcaaagacatagactcaacctaaatgcccaccaatgatagactggataaagaaaatgtggtacatatacaccatgcaatactatgcagccataaaaaggaacaacatcatgtcctttgcagggacccggatggagctggaagccattatgctcgacaaactctaacgcagtaacagaaaaccaaataccacatgttctcacttttatgtgggagcagaatgatgagaacacatggacacattgtggggagtaacacacactgggcctgtcagaaggtaaggatgggaggagtgagagcatcaggaagaatagctaatggatgctgggctcaatacttaggtgatgggttgatctgtgtagctggccactacggcacacgtttatttgtctaacaaagctgtgtgtcttgcacatgcacccctgaacttaaatgaaagttggaaattaaaaaaaaatttggtcatttagaaagactttatatttcatatttttatacatgtttatctgtattacatactataataaaggaagctagagaaaaagtgctattaagatcataagagaaaatctacttactgtttattaagtggaagtgggtcatcacaaaagtcttcatcttcattgtcttaacattgaataggcttaggaggatggggggctggttggtcctgctgtctcaggggtggcaaaggcagaaaaggtagagggaaggtagagggggaggcaggcatgcgtgatgcagcttcacagaaatacattgtaatttctgtctgacttttttgccttttcatttctctaaaaatgtatggtaccaatgctttaatcttttttccagtgcttagtttcagtgcctatgtcatagaaggttctatgtcataaatcaaaaacagtcttgaataataggaacccttctgccagattgtctaatgtcagtttgttttctggcactgcatctggtatgtcttctttctcattgtctggcactggtttggaagcactcatctccatcaagttttcttctgttaattcctctggtgacctggtgtttgttagctcttgaatttctccaggatctgcatcttgaaacccttcaccccctaccctttttgccatattcccagtctctttcatgatttccttgattgactgtgtcataaattctgtgaagccatgtgcaacatctggacaaagttttctccagcatgaatattgttttgggcttgatggttttcatggctttttctataacagcagtggaattttcagtggtgtaattcttccaaactttcatgatgttctatcagggttctctttcatagcattcacagtcttttccatagaatactgtgtgtagtgctgcttaaaggtccttatgaccccctgatatagaagctgaattatagatactgtgtttgggggcaagtagaccactttgatatttgtggtgttgaactcatggggttctgggtggccaggggcattgtacaacctcaaaataactttaaaaggcagtcccttactggcaaggtgcttcctgataggagcacagcgtctcattatctaggcctttcttgtacaaccaaaagactggcagctggtgtttatctttttccttcaaggtttggaggttagcagccttataaatgagggcaactttgatcataaacctgactgtatttgcgtaaaacagcctgtcccttcctgttttaaatcctggtgcttgcatctcttccttaataatgaatgtcttttgtggcatttcccccccttcagaatagagcacttttgtctgcgttaaaaagcctgttcaagtagatattctttctcttcgatttttttttttttgtaagacggagtcttgcttctgtcacccaggctggagtgcagtggcccgatctcggctcactgcaagctctgcctcccgggttcatgccattctcctgcctcagcctcccgactagctgggactccaggcgcccgccaccacacctggctaagtttttgtattttttagtagagacagggtttcaccgtgttagccaggatggtcttgatctcctgacctcgtgatctgcctacctcggcctcccaaagtgctgagattacaggcctgagccaccgcgcctggcctcccctatgattttcttaatggcatctgggaatttgccttctgcctcttggtcaacagtagctttttctactattattgcgacttttctttttttttaaaggcagagtctcgctctgtcgcccaggctggggtacagtggcatgatcttagctcactgcaaccttcgcctcccaagttcaagtgattcttgtacctcagctacccagttagctggggttataggcatgtacccccgcccagctaaattttgtatttttagtagagatggggtttcgccacgttggccaggctggtctggaactcctggcctcaagtgatccaccctcctctgcgtcccaaagtgctgggattacaggtgtgagccaccgtactcagggtgtgacatattttaagacagacttctttataacacatatcaaaccatcctttgctggcattaaattcttcagctttagatcctcatcttccttaatgctttaagttgtcatataatgactttgctttttctcaggtcctattagtctataggtatgctcattcttctagcaatcctgcactcacataaaagctgcatttttagtatgagattatcagtatgagattaaaagatattatgcaaaaactgcaaggttttcggacctgcgggcatagctgtagtgatgcaaattttctttcctttttttaataatgactcttaggctggattcatgtatcttaaatggtgagggattgcagctgcagacctaaatatcaagcacttcagctttttcttttaacgtcatgacttttctctgcttcttgggagtacttccagcattattaatggcactttgtgtgggtctgtgatgttattcaggtttatggtattgcactaaacatgataaaaaatatgtgacaactgcaagagatccacttttttactgtgatatgcaatttattggagagacagactgtttacgcagaggtgttcagcctcacacagcattttaagtggatacttgaaatacttgaggtcaccgcaatagcaatagaaggtggctaagaaatattacagtagtacagtatgtactgtggttaattttgtgcagttgtgatttagtactgcctctttacctttgtttacctttctcttgactgaatggcgccatgtatgatctataagtgtgtgcataagttttgataaattttcatttttgtaatagatttgggtatattttatggtagtaaatgatgaaatagactagtgtctacatgtattttaagcattcatgacatactttttcttaattttcatatttctagactatgtggtttgtctgccagtttttttttcaaattgttgcaagtctctaaaaaatgttccaatatatttattgaaagaatcaatgtataagtggacctgtgctgttcaaacctgtgttgttcaagggtcaactgtactttctttttttttttttttttgagacgaagtctctctctgtcgcccaggctggagtgcagtggtgccatcttggctcactgcaagctccgcctcccaggttcatgccatactcctgcctcagcctcccgagtagctaggactacaggtgcccgccaccatgcccggctaattttttgtatttttagtagagacggggtttcaccgtgttagccaggatgatctctatctcctgacctcgtgatctgcccacctcggcctcccaaagtgctgggattacaggcgttagccaccgtgcccagctggctcaactgtactttcctaagattattttgacaacacatcaatttcattgtgtattgcagtgtgtaccattaagtattatgtaaattgtccttatattaagctttttttttttttttttttttttgagacggagtttcgctcttgttgcccaggctggagtgccatggcacttgaccttgtctcactgcaacctccgcctcctgggttccagcagttctcctgcctcagcctcccgagtcgctggggttacaggcgcctgccatcacgcccagctaattttttatattttagtagagatgggtttcacgatgttggccaggctggtctcgacctcaggtgatccacctgcctcaggctcccaaggaagcttgtttttaaaaatattgtaaaaacaaaacccccaaatctttcattttttgatatatataaacatgactttgtgttgacacaagatggaaaattctttctttatatttcttaagtctgtaacttcatcacatagtctactagttttctttttaacatattaaatgaattatgttagtaaataaggattttccttaaatacattttggtcagcgtgaacagatattttgacatgggttacagattggtggtagccagagacgacaacttttcctttcttgctcccccctcccccccacccccaataatttttgcataggagagagtcttcttaatgtcttctttcagatgtattcatttagtttatttttaagttgacagagaaattgtatttcataatgtttttgtcttttctgaaatatttagttactgaattttcatcaacgtgtttaaaacaagaatttaagtatagcttattgatttatctaagcctttgatttggaaccaggttgaggattgccgatgaaataagtaagaaaatatcgtgccagggcaatgaaaacctatgaagatttttgagcaggagagctacagaaacttcaatacgatgagaataaattggcaacagttcatacaataatttagagggtatgcagtttccaccccttaatatcgtttttgcttctccagagttaattcacttgccattttttcctcctgcagatatatctgttcttctttcatagcttttctgtgttcacttatcataccagttcctcatttaattttctctgtttccttcaataaccgaatacatctgttctttcttgattaatctttacttgcttttctttctgtttttttgttttgttttgtttttttagatagggtcttgctgttgcccaggctggagtgcaatggtgcaatcatggctcactggaaccttgacctcctgggctcaatcaattctcctacctcagcctcctgagtagttgggactacaggtgcacacaaccatgcccagcaaatttttttttttttttttttgtagaggtggggttttaccatgttgcacaggctagtctcgaactcctgggctcaagcaattggccattcaaagtgctggtattacaagtgtgagccactgtgcccagccccttttcttgagttctcttgtttcccaatctactcttgtaaatttaagctttttaattatggtaaaatatacataacatagaatttgccatttttactatttttaaatgttcagtttagtgacattgagtacattcacagtgctgtgcgacaatcaccagtatccattttcacaattttttcatattcccagatagaaactttgagctgggtacagtggcttgctcctgtaatcccagctactcaggaggctgaagcaggaggatagcttgaggctagaagtttgagaccagccttggcaacatagtgagacttcatctctaaaatgaacattcaaaaaaaactggtggtgtgcacttgttgtcccacctattcaggaggctgaagtaggaggattgcttgaacccaggagtttgaggctgcgatgagctgtgatttgcactactgtactccagcctgggcaacagagtagacctcctctcttaaaatgaaatgaaagaaactttgtaaactttgtacccattaaacaatatctacactatacagtcttccttctcacctgtcccctcttattcttgactgtctctataaatttgccagttgtagatacaatcatgtaagtggaatcataacatgtttatctttcatgtctagcttatttcacttagcataatgctttctggattcctccatgttgtagtatgtgtaagaattttattatttttaaggccgaatattattacactgtatgtgtatagcacattctgtttatccatttaactgttggatatttgggttgtttccacctttatcaactgtgaataatgctgctatgaatattggtttagaagtatctttttaagtccctgttttcaattattttgggtattaactaagagtggaattgctagatcacatggtaattctacttaactttttgaggagacacaaaacttttctgtagtggctatagtattttacattccaaccgccagtgctattcccaccaccaatgcacaggggttccagtttctccatgttcttggccattatttattttctgttttggttttggttgtttgtgcttttgatgagcatctttatagatgcttattggccatgtgtatttctttggagaagtatctattcaaatcctttgtccattgttgagttggatttccttgttgtaggaattcctttgtatgttctggatattaattccttatcagatatattatttgcaggtgttttctcacactttgtgggtcgtcttttcactctcttaatagtgtcctttgattgaaaagtttttaattttgatgaagtccagtttatctgttttttctctggttgattgcttttggtgtatattctagaagacattgttaaatccaatgtttcataaattttctcttgttttcttctaagggtctcattgatttagcttttgcttggtctttgatccattttgtattaagttttgtatatggtataaagatcctttttgcatgttgatacccagttttccagtatttgctgttgaaaagacttgtcttttcaagacatttgaatggtcttggcactcgtgttgaaaatcaatttgaaaaaaacattctattgatttgtaaatctcttgtaatccagaaccacattattttgattaatgtagctttgtagtaagttttgaaatcaggaagtgtgagtcttccaactttttctttttgaagattgcatagctgtttggtgtcccttgagattccaaatgaattttaggattttttttccccacaaaaaatactgttgggatgccgattatattgaatctgtagatcattttgggtagtgttgtcatcttcacaatatttagagttccaatccatgaacatgcgatgtctttctacttacttatgttttctttaacttcttttagcactgttttgtagttttcagtgaataatctttcacatccttggttaagtatattactaattattttattctttgtgatgctattgtaaattgaattgttttcttaattttcttatcaatgttcattgcaagtgtacagaaatgaaactgattttcatgtattgattttgtatcctgcagctttgatgtattcaagctaacaatttttcgggttttctgcatttacgatcatgtcatctgtgaacagagatagttttacatcttcctttctagtttgaatgtcttttatttctttttcttgcctgattactctggctaaaacttccaatattatgttggctagaataagtgaaagtggacatcattattttgtttctgatcttaaggaaaatgctttcagtctttcaccactgagtattgagtattgtgttacctgtggatttttcatatgtctccattatgttcaagttattcataggttattgagggtttttatcatgggagggtgttgaattttgtaaaatgcattttctatataagtttagatgatcatgtagttcacatccttcattcttcatgttggagtattacattgattatattgaaccatccttgtattctgggagtaaatcacacttggtcacgttgtgtattccttttaagatgctgctgaattcagtttgctagtattgaggatttttttcattgtgattcataaaggatattggtctggttttcttgtatctttttctgcctttgttatcagggtaatgctggctataaggatgaattaggaagtattctcttttctttaaatttctggaagagtttgagaggattggtgttaattcttccttagatgtttcagtagaattcatcagtcaagctatgtggtcttggactttttggttgttgttggaagcttttggttacttattcagtctccttactaattataggtctattgaagttttctatttctttgtcagtttgggtagattgtgtgcttctgtgaatatattcattttatctaggtgatccaactttttggcatatcatttttcattgtattctcataattatttctgtagaatcaatagtaatgtcctcactttaatttctgatcatagtaatttgtgtactctttcttattttcttaatcaatacagctaaaggtttgtcaatattgttgatctttttaaagaactaaaattttgttttgttgatttcctttattttttttttctgttttatttatcaccactcttatttttagtatttccttccttctggtagctttgggtttagtttgttcttaagttccttaggtgtaaagttacgctgttgaaatgagatcttcttatttaatgtatgcatttatagctctaaattttctcttagcactgttttcactgcatgctctaagttttgatatgttgtctctatctcaatgaattttctgattcctttccccatttttcaggagtatgttgcctaatttccacatatcttttagttttccttctgttattgatttttatctcttaagttatttcttctttcagctaaattctgcttttgaaccctcccatgaatttttcattttggttattctttttagctccagagtttctggttggttcttttctcttcgttggtctcattcagtttatacattgttttcctaattttcttctaaagatgattgttttaaagtcttctgttaatgtcactcatctcatctgggtcaccggaattgtcattgagcagtgggcttgctgcccagtgtgcatagaagcaaatattatggcaccagcctttgataaaagaaaaagctttattgcaaggttgactagcaaggagagaggaggcagtgctcgaatctgtctccttaagctagggtctggggacaggttttataggcagagtgactatgaggggagacaggaaaatacaatgaggcatgatctcattgggctgttcaggaggtagtgcagggaccttgacccttaaattaactctgcagcaaaacagggcactccttgcttcttaatttgctctgccctgggttcagttactgaggttctgtaactgaccagagggttcctgttgcctgctgcccagatagagcctatttatcaagacaagggaattgcaatagagacagagtgtaatacacgtagagctggctaaataggagactggagttttactattactcaaattagcctctccataaatttggagcgtagtgtttgtttgttttgagatggagttttgctctgttgcccaggttggagtgccgtggcgcaatcttggcttactgcaacctctgcctcctgggttcaagcgtttctcctgtctcagccttctgaggagctgggaccaggcacgtgccaccatgcccggctaattttttgtatattgttttagtagagatggggtttcactgtgttagccaagatggtcttgatctcctgactttgtgatccgcccacctcagcctcccaaagtgctgggattacagttgtgagccactgcgcctagctgggtagtgtttttttgaaagtagtttggtgggcagggagctagggaatgggtgctgctgattggttcgggatgaaatataggggtgtggaaaatggtcctcatgtgctgagtctgccacaggaccattgaatcatgagtcttggatctgggtggagccatcttgttgtgagaaatgcaaaagtctgaaaagacatttgcaatccgaaaaggccaatcttaggttctacaatagtgatgttacttataggagtaattggggaagttgcaaatcttgtatcctccgaataatggctggtaattgtttaactatacctacatcttagcagaattcatgcctctgtcatccttctaacctggtggatggccttttattagttttacaagtggtttaggtttggggaggctattatcatttaaactgtaaactaaatttctttcaaaattagctcgggccatgcctaggaatgaccaagggcagtttggaggttaaactagaggtaaatttggctcctggatacaccaatcaggcatgctggattaatctgcacatgctcaggctttgtgatttgcaatctgggatgtagattgcagtttgtgattacagaaagcccattgtcagccgggcgcggtggctcatgcctgtaatcccagcactttgggaggccgaggcaggcgtatcacctgaggttgggagttcaagaccagcctgaccaatacggagaaaccccgtccctactaaaaatacagaaattagccagtcgtggtggcacatgcctgtaatcccagctactcgagaggctgaggcaggggaatcacttgaacctgggaggtggtggctgcagtgagccgagatcgcacccttgcactccagcctgggcaacaagagtgaaactccatctcaaaaaaaataaaattaaatttaaaaagtccataagtccattgtctgggcttgtttgtcatcttaattgttcctttgaatgggccattgttttctcttttgttgaaaatcagacatttgactattatgtggtaactctgggaatcagatttctcccttcttctgggtttgttgtttttcgttttatttattgattgattgagtacttgttgaaggctgtagtagtccatttgtcctgagactttccaaacaatttttgcaaagactagtccttgttgtgtgtgattattgaattctgttcctttagtgtgtgttcagcttaagttacagagatttcctcaggagttctcccagtttttgcagttagctctgtgatgggttactctttcatctcttaagtaggcttcttttgaacatagggatcatcttcttaggtattttctgagcatgaatcttgcttggtcatgtacgtgactttctaaattcccctgtatacacaactgcttttgaatattcttttttttttttttttttttgagatggagtcttgctctgttgcccaggctggagtgcagtggcgccatctcggctcactgcaagctccgcctcccaggttcacaccattctcctgcctcagcctcccgagtagctgggactacaggcgcccaccaccatgcccagctaattttttgtatttttagtagagacgcggtttcaccgtgttagccaggatgctctcgatctcttgacctcgtgatccgcctaccttcgcctcccaaagtgctgggattacaggcgtgagccaccacgcccagagcttttgaatattcttatttcccaaagagcctcaccttatcttctctttagggccttacctagtcttttgtattgtcccaggggtctgtgagtctgtagcggccttggaactttaagagcagggcctgctgctctttttcacctgagttttgtgttaggctaaatagaaatgaaagtcttactcaggcctttaggtatcccccagaagggttagaactacaaagctacagaactttcctgctctttgactgttttccagcacttcaacaaagtttgttcaggcagtttctctttgttttttgatgtttctctgtggggaacaaaacctcagagcttcctatttcactattttccttgaacttaataatttataatgtgaaaagcaactgtgttaagtttggctagaactaggtgatataacaaaccctcaagttaagtggcttaacccaataaagtttatttctagtttacctgacagtccagagtgggtatacatgattagtatcagtgaagaggtggtagaggtataggagtgtttgtgtgttggggctgggggacattctgcttcacgtagtctttcagagacagagttgaatgtctttaacatgttgccctggagaaccttagggggaaggggaaagggaaggactgagttggaggctgttatgagctagacttggaagtacaatggtacacctgttttgacttacatgtcttgggctagatctcagtcatacggccatatttaattgaaagagaggctgagaaatgtaaagtagttatatgttataggaagaggatggaactggaaagtgattttggcgaatagctagtaatttaacccatatcaattgcacacagaacttcctcgagcttccatgttctgttgaagcagctgtaagatacacattttatattccattgaggaggaatgaaaagagaaagcattgccaattaaactattacacagtgctttcttagaataaagtattatttctttcaataaatgcaaatataaaactcagtaaatataaaaattattttacatttactcagttttatcatgtatcatctttgaacatacgttgaaagtataagtgaaataaattgattaaattattcctaaaatgtctttgtactcagagcccaattcttttttttttttttttaattatactttaagttctgggatacgtgtgcagaacatgcagttttgttacagaggtatacatgtgccatggtttgctgcacccatcaacccgtcatctacattaggtatttctcctaatgctatctttcccgtagccctcccccacccaccgacaggccctgatgtgtgatgttcccctccctgtgtccacgtgttctcatttttcaacttccacttatgagtgagaacatgtggtggttggttttctgttcctgtgttagtttgccgagattgatggtttccagcttcatccatgtcccggcaaaagagatgaactcattcttttttatggctgcatcatattccatactgtatatgtgccacattttctttatccactctgtcgttgatgggcatttgggttggttccaatattgtgactagtgctgcaataaacctatgtgtgcatgtgtctttatagtagaatgacttataatcctttggtatatacccagtaatgggattgctgggccaaatgatatttctggttctagatccttgaggaatcgccacactgtcttccacaatgtaaaagtcttcctatttctccatgtcctctccagcatctgttgtttcctgactttttaatgatcaccattctaactggcgtgagatagtatctcattgtggttttgatttgcatttctctagtgaccagtgatgatgagctttttttcatatgtatgttggctgcataaatgtcttctttggagaagtgtctgttcatatccttcgccctttttgatggggttgtttctttcttgtaaatttgtttaagttccttgtagattctggatattagccctttgtcagatggatagattgaaataattgtttcccattctgtaggttgtctgttcactctgatgatagttgcttttactgtgcagaagttctttagtttaattagatcccatctgtcaattttggcttttgttgccattgctttttatgttttagttatgaagcctttgcccatgcctatgtcctgaatggtattcttctaggttttattctagggtttttatggttttaggtcttacatttaagtctttaatctatcttgagttaatttctgtataaggtgtaaggaaggggtccagtttcagttttctgcatatggcttgccagttttcccaacactgtttattaaatagggaatcctttccccattgcttgtttagtcaggtttgtcaaagatcagatggctgtagatgtgtggcattatttctgagccctctgttctgtattattggtctatatatctgttttagcaccagtatcatgctgttttggttactgtagccttctagtatagtttgaagtcaggtagtatgatgcctccagctttgttctttttgcttaggattgtcttggctatgcgggctgttttttgattccatatgaaatttaaagtagttttttccaattctgtgaagaaagtcagtggtagcttgatggggatggtattgaatctataaattactttgggtagtatggccattttcacgatactgattcttcctatccatgagcgtggaatgtttttccatttgtttgtgtcctctcttatttccttgagcagtggtttgtagttttccctgaagaggtccttcacatcccttgtaagttgtattcctaggtattttattctctttgtagcagttgtgaatggaagttcactcatgatttggctattattggtgtataggaatgcttgtgatttttgcacattgattttgtattctgagactttgctgaagttgcttatcagctttaggaaatttgggggctgagatgatggggttttctaaatgtacaatcatgtcatctgcaaacagagacaatttgacttcctctcttcctatttgaataccctttatttctttcttttgcgtgattgccctggccagaactttcaatactatgttgaataggagtggtgagagagggcatccttgtcttgtgctggttttcaaaatgcttccagcttttgcccattcagtatgatattggctgtgggtttgtcataaatagctcttactattttgagatacattccatcagtacctagcttattgagagtttttagcatgaagtggtgttaaattttctgtatctattaagataatcatgtggtttttgttgttggttctgtttatgtgatggattatgtttattgatttgcatatgttgaaccagccttgcatcacagggatgaagctaacttgatcgtggtggataagctttttgatatgctgctgaattcggttcgccagtactttattgaggattatcacattgatgttcatcagggatattgcctgaaattttctttttttgttgtgtctctgccaggttttggtatcaggatgatgactgtcctcataaaatgagttagggagagtccctctttttctgttgtttggaatagtttctgaaggaatggtaccagctcctctttgtgactctggtagaattcaattgttaattgtctggtcctgggctttttttggttagtaggctattaattactgcctcagtttctgaacttgttatggtttattcagggatttgacttctttctggtttggtcttgggacagtgtatgtgtctaggaatttctccatttcttctagattttctagtttatttgcatagaggtgtttatagtattctgtgatagtagtttgtatttctgtgggatcactggtgatctcccctttatcatttttattgtctgtttgattcttctctcttttcttctttatttgtctgggtagcgttctatctattttgttagtcttcaaaacaccagctcctggattcattgatgttttgacgggtttttcgtgtctgtatctccttcagttctgctctgatcttagttatttctagtcttctgctagcttttgaatttgtttgctcttgcttctctagttctttgattttagatctttcccactttctcctgtgggcatttagtgctataaatttccctctaaacactgctttagctgtgtcccaggtattttggtatgttgtgtctttgttctcattggtttcaaagaagtcatttatttctgccttaattttgttatttacccagtagtcattcaggagcaggttgtttagtttccatgtagttgtgtggttttgagtgaatttcttaatcctgagtgttagtttgattgcactgtggtctgagagactgcttgttatgatttccattcttttgcatttgctgaggagtgttttactttcaattatgcggtcaattttagaataagtgggatgtggtgctgagaagaatgtatattccgtttatttggggtgtagagttctgtagatgtctattaggtccacttggtccagagctgagttcaagccctgaatatccttgttaattttatgtgttgttgatctgtctaatattgacagtggggtgttaaagtctcccactattactgtgtgggagtctaagtctctttataggtctctaagaacttgctttatgaatctgggtgcacctgtattgggttcatatatatttagcatagttagctcttcttgttgcattgatccctttaccattatgtaatgcccttctttgtcttttttgatctttgttggtttaaagtctgttttatcagagactaggattgcaacccctgttttatttttttgctttccatttgctcgttaaatcttcctccatccttttgagtctatgtgtgtctttgcatgtgagatgggtctcctgaatacagcacactgatgagtcttgactctttatccaatttgccagtctgtgtcttttaatcggggcatttagcctgtttacatttaaggttaatattgttatgtgtaaatttgatcctgtcattatgatggtagctggttattttgcctgttaattgatgcagttgcttcatagtgttgatggtctttacaatttggtatgtttttgcagtggttggtaccggtttttccttttccatatttagtgcttccttcaggagttcttgtaaggcaggcctgatggtgataaagtctctcagcatgtgcttgtctgtaaaggattttatttctccttcacttatgaagcttagtttggctggatatgaaattccaggttgaaaattcttttctttaagaacgttgaatattggcccccactctcttctggcttgtagggtttctgcagagagatctgctgttagtctgatgggcttccctttgtgggtaacctgacctttctctctggctccccttaacattttttcattcattacaaccttggtaaatctgacaattatgtgtcttgggacacataataagagcacctgggggaaggggcggctgtgagtgcagctttagcagaagtaaatattcctgcctgctgactctaaagacagcagtggatctcccagcacagcgctcacgctctgctaagggacagactgcctcctcaagtgggtccctgacccttgtgcctcctgactaggtgacacctcccagcaggggtcgacagacacctcatacaggagagtccttttccaagttgttccattctcccttcactttcaggtacaccaatcaaacgtaggtttggtcttttcacatagtcccatattttttggaggctttgttcattccttttcattctttttttctctcatcttgtcatcactctttatttcattaagttgatcttcaatctctgatatcctttcttccgcttgatcgattcggctattgatacttgtatatgcttcacgaagttctcgtgctgtgtttttcagctccatcaggtcatttctgtttttctctaaactggttattctagttagcaattcctctaaccttttttcaagtttcttagcttccttgcattgggttagagcatgcttctttagcttggaggagtttgttattacccaccttctgaagcctacttctgtcaatttgtcaaactcattctctgtcccattttgttcccttgctgacgaggagttgtgatccttgggaggagaagaggcattctggttttcggaattttcagcctttttgcattggtttttcctcatcttcgtgatgtggacgtcctttttgttgatgttgatgctgttcctttctgtttgttaattttccttctaacagtcaggccccactgctgcaggtcagctggagtttcttggaggtccactgcacacccggtttgcctgggtatcaccagcagaggctgcagaacagcaaagattgctgcctgttccttcctctggaagctttgtcccagaagggcacctgccagatgccagccggagctctcctgtatgaggtgtctgtcgaccccggctgggaggtgtcacctagtcaagaggtaaaagggtcagggacccacttgaggaggcagtctgtcccttagcagagtgtgagggctgtgctgggagatccgctgctctctttagagccagcaggcaggaatgtttacttctgctgaagctgcgctcacagccgccccttcccccaggtactctatcccagggagttgggagttttacctgtaagctcctgactggggctgatgcctttctttcagagatgccctgcccagagaggaggaatctagagaggcagtatggctacagcggctctgcggagctgcagtggactccgcctagtttgaagttcctggcgctttgtttacactgtaaggggaaagctgcctcctcaagcctcagtaatggcagctactctccctccccacccgcccaccaagcttgagcatcccaggtccacttcatactgctgtgctggcagcaagaattacaagccagtggatcttagcttgctggaccccgtgggggtgggatctgctgagctagaccacttggttccctggcttcagccccctttccaggggaatgaacagtacggtcttgctggcgttccaggcgccactggggtatgaaaaaaaactcctgcagctagctcggtgtctgcccaaacagccacccagttttgtgcttgaaacccagggccctggtggtgtaggcaaccaagggaatctgctggtctgcaggttgcgaagaccatgggaaaagcgtagtatccaggctggaatgcaccattcctcatggcacagtccctcatggcttcccttggctagggaagggagttctccgaccccttgtgctttctgggtgaggtgatgccccaccctgcttctgctcgccctccctctgtcaaccagtcccagtgagatgagccaggtacctcagttggaaatgcagaaatcaaccgtcattgatctcgctgggggctgcagaccggagctgttcctattcggctgtcttgctccagagcccaattcttctcaatcatttttttcttacccagagttgtctgtttttccacagagtatcttttctgtgcagttaggaaagttgatgatatagcatacttcatccactgtactttgatctgggattttcttcttaaccattgatactggtttctgtaagtgttaatgctggcactttcttcatgttaccggatgatgttaatgaaaggttttcagacagttgctagctcatattctttcttcaactgttcgttaaatggattgttgcctggaatgttgagaggttgcaattgtccagttatatcactggaaaaaacaactaagttcttatacaggcagagagaactgtcattgtcaccacctcttcagtagcaactataaatgtctttaattgtaagccatctgccaatttcagagaagttaacatgttaggggaaaaaacgcatcatagaattgaacatatatagtatgttgaatttgttttgaaattcaggtttttgtgtcttgtaatatttgaggctttcctccttcccccatcatgcctagcctagtcaaaatactttttattgaatttattaaaataattacagtttatcatgatccatagtttagaaaaagaaaggatatgggggcaagatgggtaacttcagtgactttaagggctgaaagcaacaatttggagcatcgtgtcaaagttgtgggaatctgattttagaacaatataagaaaaaatttaaaaaattttaattacttctgaatgaagtggactctgacagtgaatttgctgtcattgaaagtattcagagaggttctagatacaaatcacccagacacagtaaaagcaatttcttcactgggtggtaattgaagaatatgttgtttaatgtgtttttctgactattgatattcctattctaaaataatttacctttgtactaagtggccttctcttttcagatactcaacaatgtaatttatcgatactttctgttattgattggaacaccattgagtttctttcttaatgtaagacaggcaactaaatgcaaattactgttctgtttctaattaagtgatgaaatacactaagccaggtcattctttgaaacactgattgacacagtgggaggagggagctaagaaatagtactttttttccttgcagattttacttgcaaagtattgtaacctgattttccttcaggtcacctagattggagtacagtgatgcgatcttagctcactgcagcctccaactccagggcttaaaccatccttccactcctagctcagcctctggagtagctaggactacggaaacttgctaccacttgtggctatttttttattttttgtagagacaggatcttgctatgatgcccaggctggtctcaaatgcctaggctcaaaccatccatctgcttcagcctcccagtgtgctggggttataggcatgagttactgtgcccagcctatactcttctaatttttgattctttcagggtttagttggtgaaagagccattatgaattttattttttaatttaatttctttttttttgagatggagtcttgtggtgatgcccaggctgacgtgcagtggcgtgatttcggctagctgcaacctctgcctcccgggttcaagcgattctcctgacttagccccactgagtagctaggactacaggcacacaccaccatgaccagctaatttttgtatttttagcagagacagagttttccagtgttggccaggctggtctcgaactcctgacctcagaggatctgcctgccttggcctcccaaagtgctgggattacaggtatgagccagaattttatttttaatcaaaaaaaggttttaaggaaatggctcaccttccttccctccctccctccctccaaaggacttgtggtcagactctttggaattgccagtacttaatcagctgaatgaagaattttctgatctttctgtttagtagttcaaatggtcattaccaggattctttgtatacttttggggagcaaattaaatagatgaaagacagccaacttttaggatgagagataggcatagatatatcgttttcttatcttcttccacatactcaaatttagatatcaggttatccatgatttgctttttagttcaccagacatagtgaagttaacactcctaatttagttttggctatatataacttgctaacagctctagcctgggattttaaagacagcttaactatgttcatggaatgctatgactggctaaatatgactctttaatgtttcataaaacatgtctttttcctaaatagggttgtaacattctcttaaatatttcatgcatgtctttctctctctgtgagacagatctctctagatttctctggttttatttctgacatgctatatgaagtactttttatttaaaagtaagtacaatatgtagtatctcagtgtgcatatggcttggatgcttactttgacgatgaaaaattgcttaaatatgctgacatctgaattgtatctgtaaattaatgttagcaacttgagactcagtaattgtttcttaaaatggattctaattagttacaagtaaaaagtaactttcccttaaatgttggttgtattaattacaaatactttaaaaagatatattaaaatgataaatctaatttttttcctggacattgatttatgttgtgtgatgacataacagtactggaaatcagtagaggtgacactgctgtacatttgtagctatttatattttgttgtatttttataaaacaaagaaatacatcagatcatagtcattataaagcattaaaaagatatgaaaacatacagttaaaaaatgatagcttctccttccctaaacacccaattcctaatgaataaatactgttaaaaattaggtgattatcttcccacactttatgcatttttagtttatttaatgcaccattgtgtcagacattgttctaaggattaacaaatagaagagagtttatatgaagaggcaaaaacactatgaagtaaataataatattgggaattgaggcctagagaggttaactaattgtatggttaacctagacagtctggcattaagatctgtgctcttagtcatgttgcgtcttatgcttttacaaatatactattaatatatgtactcatatatagtattttgttagcttttagtgtaaaaatttattattgtacatggtgctttgaggcttgtttttttctcacttaaaactattttttgatgatctcattattttttaaatggctgtgtatgttttactataacttatttaaatttatttactataaattattttgtctttaatgaactattagtttttttccaaaattgcaagcaaggttgcagtgaatatgtttgttacccttgtgtgtatgtgtgaggattttttgtgagattcctacaaatgatgttgggtctgaggcagtgcatatttaacacttaagtaaaacttccaaatgacccttcaaaatggccgaaaaggtttatacccacatcagttttatatgagtacctgttttctcataactttgccaacaaaaggtacaaataatccctgaaatatttgccagtggggggtaaagactagtaacgccttgctgttactatttgcatttcttaacattttttatttcttagccatctgaattttttgggtcaattacctgttcataacctttgcccatttttttctattgcattgcctgtttttgtattttaactttgtaaatgttaacagtatttttaagtttgttgttgagcactatataagttggctgtggaaccactatagtgattgagaatgcagacttgcaccagacaggctaaattctagctctgccacttctttgggaatatgcctaatctttgtacatcagtttcttcattggtaaagtgggattagtggtggtacacctcaagagattattgtgaggattaaataaattattaattacaaacagcatataactttctgatctttagtaagtgctagcttttataattattattgctctaatgatttatgctatcttgttattagcacaattttcaatttttagtcacctgttttaaaaaactgtctttttactaaattaagactctcttcattctaatatttataagaagaaagtagagtttaaatttcttcagaagcttggtttttcttttttttttttttttaacttttggtatattttctatatggaatttctttttgtgtggtaggcggtaagttgtcttagtttttttccccccagatatctatctagttatcttcactgattaaaaattctgtgttagtcatgtattaaagttttcatgtatgtagaaatctttttctagattctttatttcattattccccttgcgatctgtttattaactcttgtgtcagtatgccactgttacagttacaatagtttctttatatattttgataattttggaaaaatcccctctcatccttctgttttagatttgtcatagctgttttgatacacttttccagactgattgtagattctattctattcatagaatattcatagcattctattcatagaatattcatagcattctattcatattctattaaaacatcctgttgggttttgaaagggctaatatctttacagtgttgagtgttcttatgcaaggatatatctttcccaaaaaattaatgaacgtgatacatgcacatggagaaagaatcaaacagtacagaagagcataaaatgaaatacaagtctttctttcaagctcacaccccaaatccataaccaccattagtattcatgtatggatgtgtatgtgcttcatggccttattcaatcaagcaccctagtcttgatttactgctatattccagaaaacctttcaatttatataaatgtgtgtgtagaatttacctttccttttatcacacagaatgatgctctagtattcttcactcttttgtatcttttacttttttccactttgtaatgtatcatggaaatcctttcataagaaattctattgatctacctcacctatttttattttatttatttatttatttatttatttgagatggagtctcgctctgtcgcccaggctggagtgcagtggcgctatcttggctcactgcaagctccgcctccagggttcacgccattctcctgcctcagcctcccgactagttgggactacaggcgcccgccaccacaccaggctaatttctttttgtatttttagtagagacggggtttcaccatgttagccaggatggctacgatctcctgaccttgtgatccgcccgcctcagcctcccaaagtgctgggattacaggcgtgagccaccgcgtccagcccctacttcacctatttttaaaggcttcattgtctgtcattgtatggaagtactgtggttttatttaatcaccccctattcataagcattttgattataataattttcattttgctagtgtaactaatacagtatgttcttagagatttatttttgtattcttgtgtttatgtctgtaagaataatttccagccatggaattgctagggtatgcaatttcaaattgacagacgtttttagtttccactttaaaaatgttgaaccaacgttatattcccacttttagtgtatgcaaatgcatatttctcagcaccaacactggattatatcaactgcattatttttgccagtatgaatgttttgctatttttaaaatcatgagtgagattaaacctgttttaacattcgtcagccgtttattataacaaataacatttattgagcacttacatgggctaggcactgttctaagtgggttgcatattcatttaatgaattgtttcctcacatcatttgctcatttaaaaaaatgttttttcttagtgaactaagagttcattgtacattaagaaaattacctttaatcatatgtattgcagattttttccattttacttattgtcttgatgtgtatgtatacattttatacacagttttacatttttatgtgcttagattatgttttatgatttttttcttcttggtcttaatcggttttggttaagcttattgcttaaccatgaatatgatcatttttaccatataatttcctaattggttattgctcagttataggtaagtgttgattttcaaatactggtgttgaactctgttattcatcagtcttttaaggcatactcttggactttataggtagatgataaaagcttctgcaagtatttttatagctttgtacttgctatttctctttcttttcctttgcattagctaaggtcaccagtacagtgttaaacaatagtgctcatagcaggcattcttgccttgactttaatgcattttgttattcagtgagatttattcatgtattaattaatatgatagtaattttactgtttaggagcacttattttcagggaaagtagcctactaattagacattaacaagaaggtaaagatacctaacttttatatcagtatgtggtcttgtgcaaacagtgtattctcaactctcccatttatatagtgaggataattattaatctgtaatgtaaaattcctgtaaatgactaagcaatatgtaaaatatcagagcccacatattaaagtatcatcatatgacaggttgccatttgttgagttattttcaagtgcttacggatattttacactggggcatgacttctgagttcgtggaaaattttttgttctgaatttttcagaatggctgatctgaataataacgtatatggttcatcagcataatatgagtaaagcctattcaaacctttacatttctttcctgtcggttcccaaaattattcagagaaatggaggggtaaagtagtatagataaacaaaattgttcatcaccagcccatgtttgaaatataccattaagatagacagcggctgggcgcggtggctgacgcctgtaatcccaacactttgggaggccaaggcgggcggatcacgaggtcaggagattgagaccatcctggctaacatggtgaaaccccgtctctactaaaaatacaaaaaattagccaggcgtggtggcgggtgcctgtagtcccagctagtctggaggctgaggcaggagaatggcgtgaatccaggaggtggagcttgcagtgagcctagatggcgccactgcactccagcctgggtgacagagcgagactccgtctcaaaaaaaaaaaaaagctagcagacagcagttattcaataatgaataagacacgatttctgcctttttgaattgtatatgaggttaagtagcctttacttgtcttcccaagtgagatttactgaaactaacattttagtagtctcccattcctagcacaatgcctggaatctgttgggttctcagtacatttttgcttagtgtacttgaacttcagtgtttatgaaacatagattcctgcatattctggttcagtaggtattaattaggacccaggagtctgcactgttaacaagcacctcagggtgttttccggtggtttctcttaataaatacaaagaaaattttctgaagagagatgttatattcatctcatagaaaatcaattttgggtgggaggaagtttcactgtaatcttcatgccttatacaaaggtaactttgccttttacttcagacttcagcttttcatttaagaggaatctgtatatttagcacagtcgtgggttgttggtatccacttagtaaatatctattgattaccttatttttccctgctctgtcatccaggctagagtgccctgccgcaatcttggctcactgccacctctgcctcccaggctcaagcgattctcccacctcagcctcccgagtagctgggaccactggtgtgcaccaccacgcctagccacttttgtgttttttgtagagacggggttttgccatgtttcccagaccatgttgattattcagcattgattacttgcagtaattatggaattagtttttaatttactaatccagcgttttgtggtaaagttacaattttaaatgtagtttaaaaataaaacgtttttaaactggtctctgtttttcctccttgggaccttgtcatagcttaggtggagcttgaaataatgaagcgtgtcagatgtggcataacatggttttttaatgaccaaaatgtaacttttattttaaagggtattatatacctggttatattgaaaggtagccttgagatgtataagagccttctttgtattgttacacactcttccaaaatatggacaaatcataaatgatgaaaacatgattgcaattttgtagaatttactagttttggcatcattaatttggccaaaatacatgtaataatgggaatttaatgcattataggtttctataaaaattctacaattatagaaatatttttacagtgtcctattcagtaattaataaagccttctttcatgcaattataaatgaataccaatgtcctattcagtaattagtaaaggcttctttcatgcagttataaacagataccaatattttgtattggtggacgtgaaaatatttatttggtaatcttagtaagggatgcatattttttgattgaagactatgcatttacccagctcaaaggaatggatattttatttttgaatttaactcagtgatgtcgctaatctatgtgaacacgccaactgtgtgtgtgttggtggggggggtagttagtaaccatggagctaaggattgatgaaggttggtgataaagggaaacattcccttggaattaagacattgttccttgctgggtgcagtggctcatgcctgttactccagcaccttgggaggaggctgaggcgggtggatggtttgagcccagaatttccacaccagcctgtgcaatgtggtctctacaaaaaaaaaccccaagaaaattagcccagcatggtggtgcgagcctgtagcctcggctactcaggaggttgaggtgggcggattgaggccagaagcgggaggcagcagtgagcttgtgagggtacgggggcgagataactgtctcaattaaaaaacaaacaaacaaaaaccaggcgcagtggctcacgcctattatcccagcactttgggaggccgaggcagtggatcacttcacgtcaggagtttgagaccagcctggccaatatggtgaaaccccgtctctactaaaaatacaaaaattatctgggtgtggtggtgggtgctagtagtcccagctactcaggaggctgaggcaggagaattgcttgaacccaggaggcagaggttgcagtgagccgagatcgtgccactgcactccagcctgggccacagagtgagagactccgtctcaaaaaaaaaaaaagattctgtgtattagacacataaagcacttgtgtgccaggtatagttgtgttttacaaatattgacttatttaatgactacaataactccatgaagtaagtacaattattatttctttttacaaatcaggaaactgaggcacagagaagttagagaacttgcccaacgtcatactgctgttgagtggcaaagttgggatttgaacccagaccttctatcctcttcacctttgttaatgctgccttttgtttcctgaaagcattgctggtgtgtttatgcgttatgtctttactactaattatatttgatttttggaaagatgtggtattttatgctgtgcattatgtcgtttttgtggtttataattcataatgccatgatgtttttaatttaacaaacaagtattagaaaaggtaaagttgttgtatataataactttgctaataatcactgaacgttgtctcagcaagtatatgtgtaatgaatataaatttataccattaaaaaaaagtagccattcattcattcacattttcttgtaattctgcttgtttccatatttgcacttaagatctgttgaacgttaaaacaaatttgcttccttagattttttaaccagtcaccatttttttaagttggtaggatgggccatattgaagataaactatattttacaaattttatcagcatgctctatgaacttgcttctcaaactggagtattaacatatgtatgtgtttttaccagggtgtttgtgaagctacacataaaagtattactcttttaaagtaccatttctagttctaaagattggtgagggtggaaatattaagtactttaaattttcagcttttaaaaattttttatgttgaaactaaatgatttttaagaagcaaagaatttcacataaattatggttgaccatcctagagaccatgaaggttgtattaattcattccatggaaaacttttaggagtacttgattatatttgaagtaaattggtatcttggaaagttgtgaaattggtgaacctgccataccaaaatggtaaacaaaaacaaaactttcctggggtactgaaaagaatgatgttaccaaaggcacgtcttgttttaaatcttatgttttatttttttctttaatcttaacaaaccccacttttaaataaatccttagtaaaattaggatttatttggggctgttaatttacaaaaggattgattgtgatattcctttaaatagcttgcttcttcagtttacaaatgttcattatattcataatgttcaggcctgcatataaataaagcagggaaaaccggtgatagatacttagttttttaactataaaacatcctggtaaaaacattaaaaggttgtaaattggggaacctgtatagccagtgtgttttttaggttggcatatataagtgatattgatataattgtcttttgtttcattctaaatactgagcttagggcttgaatttgccatctgtttttttttttttattaagtatgaccattaaaacaggaataatttgattgaagactacgcatttacccagctcaaagaaatggatattttatttttgaatttaactcagtgatgtcgctaatctatgtgaacattgtagagtgacataaatgtcttctttagagtatccagatggaaattgtggcacaatgcttttgtatttcagtgacttcagaaagaaggtaggcctttaggagagtatctggggaacctttcaatagggtaattgtggggatagcaaattaagtacagtcgtgtgttgccaacaacagggatatattctgagaaatgtgtagttaggtgatttagtcattgtgtgaacatgatagtgtgtatttaccacaaactgagatggtatagctacctatcacacacctaggctatatggttatatatagcatagcctattagtcccaggctacgaaagtatacagcatgttactgtactgaatactgtaagcagttgtaacacaatagtatttgtgtatctaaacatagaaaaagtacagtaaaaatagagtgtaaaagaaaaaaggtataatttttttagcttaatctgttcttttaaaaattatatttcaataagtttttggggaagaggtattgtttggttacatgaataagttctttagtagtgatttctgagtttttggtgtacccattacctgagcagtgtacactgtacccaatgtataatcttttatccctcacccccatcccacccaaatatggtatacttgtttagggcagttagcttgcaggactgaaagttgctctaagtgagtgagtggtgagtgaatgtgaagtcctgggacattactatatgactttataaccactgcacttaggctacactaaagttgtaaaaaagttaagtgattgtgctatgacattatgacagctacagcatcattaggcagtaggaatttttcagcttcgttatgacattatggaaccactgttgcatatatggcctgttattaattgaaatgttgtgtggcacatgattgtagtgggcatgctattctggagtttattttctttgtggaatttgccatctaatagcagagataagtataaaacattttcttttagtagaaagttaagttagaaggagtatactttgttcttttggtttgagtgccatttagacttgagtgaagaagaaaaatagttggtagaattcgcatagttctcaggtttcagattcatagtctgagtttcctgatttgtcactaaatttgtttctcatccaaacatttttaatttacctcatctgtaaaactatgtagattgcaaatttttataatgtagctaattacttttataaaagagaatatttaaaacaaattgtgcatgatagaggaatttgtatcttgaagtttcttgtgctttaagtaggagatgaaccagaagtatgaattaaattgttggagagttttttgatttttctttttgcttgataaacaggaaattctggatatgtgatagtaaatgtttgaggctcctctaaggaagtgctccatcaattttctgtccttgctattttggaggggaaatttttcattttgaggacataatttctatgatatgataaatactaagaatttttcaaaaaataaggcaaatatgatagcaatgagtccagattgcagtgggaaagaaatataggaataagaaatacttctgtaacagctctggaaaacaggaaaagatgaaatcataaaccagaaaattttgaggctttctagaaagatgtaaggctgacaagattagattcctgaaaaccattagtattgaacagcttgtactacacataggggaaagtatctggtttctgagtagaaaagtagacttgcttacaaattcacctagcttagagatgtcagggctagggcagagaaatggctctgtgagcagtatcaaggtaattagaagactctggaattgatgagtcttgaagaaaaatctgtctgttcctctctcttctttaccacactaagagcagagtctgctcacaaaatccaatagccttccattatggggttgatggagatgggggagactcttgagggaagtaaagcagtgattttcaccagccatcagtacagaacaatccggatttaaaaagatgaagacaatgaggaaacactggatattagaggaaaaattaacagtgtaaaagaaaggactggtactgaaacaagcaaagcaaatagctcagagataatagtttatatagaaaataagaaactgaactttttagtattgggaagatacagtattgagaaaggaaccatgaacaaaaaattcttgacaattaaaaatatgattgccaagaagtcaaaaaatagagaaggttgtagaatccagagtactaagttgattccacagctgctctctgaacatttgttgacctagaggcttgcagttaaaggtcacatggattttaggagagagatctttgggccttcaatcattagattgaagagttagaaccctgcagtggaaaaaacacactcaaagtgctttttcctatgttcatactcaccaattaacacagaagactcctgtgacctcaaaatatgtaggatttcttcccaccagtgagtgagcagtcagttctgcagacaccagctagtgtcctccaattcaattcttttcttctttttgagacagagtctcacgctgtcgcccgggctagagtacagtggtgcgatctcagctcactgcaacctgcaacctccgcctcctgggtttaagctattctgccttagcttcagtagctgggaatacaagtacgtgccatcatgtccagttaatttttgtatttttagtagagatggggtttcaccgtgttggccagactggtcttgaactcctgacctcaagtgatctgcccgccttggcctcccaaagtgttgagattatacgtgtgcgccaccgcgtgtggctcctccaattcagttctcacactatctacctgaagacagcatcaaagcccagaagttgagggttcagtctcacaaaactgcccattactcctgataccagttgcaaacccaggtggtgggtttttttttttttttattgagacatgatcttgctctgtcacccaggctggagtgcagtggtgtgaacacagctcaccacagcctcgaccttctgagctcatatgagcctcctgcttcagtctcccaagtagctgggactgcaggttcacatcaccatgcctggctaatttttaaatttttttgtagagatggggtcttactatgttgcctgggctggtctcaaactcttgggctcaagcagtcctcccaccttggccttccaaagtgctgggattacaggtgagagccactgcttctggctcccctgggttgttttacctgtgcttctgacggaccaactataaatcagggatctcacaccctttccttggtttcagttaagctgctgaagtggcttacagaacacagggatacacatttaccagtttattataaaggacattacaaaggatatagctaaagagatggatagggcaaggtataggaaggggcatagagcttctctgccttctctgagtgtgccaccctagaggaacctttatgtgttcagctatctggaagctctcagaagcctgtcctattgctacttttatggagacttcattggataggtgtgattgaagaactgtgtagaaatgtgattggacaaaaaggttatgagctaatacttatagactgagtgggaaaacctagaaaggccggttcagattcttagcctctctgtgcactgttaatttctccagggtatgggagaacctcttctgaaatgggtgtcttattacctgcagtcagacaacgtaggtcagagaatttctttatgggcagcttcaagatggaaaggcaggggaaaattcctgccttggggagaaaaaggatcatgtgaaaggagggaaagagaaggtcagagacattaccttctgaggcctacttctgaaggccaatgtataacaaggactgtcagtgttatgaaccaggatccatgggcgaaaacctgtgtcatctatctttcacacctgcataaagccaggattcttcacgataaggcttcagtgaaagggagcctagaaaattaaatttactttccacgagaaagacactgtgtcctgaattggtgggttcttggtctcactgacttcaagaatgaagccacagaccctcgcggtgagtgttacagttcttaaaggcagtgtgtccagagtttgttccttctgatgttcgcatgtgttcagagttttttccttctggtgggttcgtggtctcactggctcaggagtgaagctgcagactttcgcggtgagtgttacagctcttaaggcggtgcgtgtggagttgtttgttcctcctggtgggttcgtggtctcgctggcttcaggagtggagctgcagaccttcgcggtgagtgttacagcttataaaggcagtgtggacccaaagagagagcagcagcaagatttattgcaaagagcgaaagaacaaagcttccacagtgtggaaggggacctgagcgggttgccactgctggcgtggcagcctgcttttattctcttatttggccccacccacatcctgctgattggttggtccattttacagagagctgattggtgtgttttacagagagctgattggtccgttttgacagggtgctgattggtgtgtttacaatccctgagctagacccaaaagttctccacgtccccactagattagctagatacagagtgttgactggtgtatttacaaaccctgagctagatacagagtgctgattggtgtgtttacaatcccttagctagacataaagattcttcaagtcaccaccagactcaggagccccgctggcttcacccagtggatcccgcactggggctgcaggtggagctgcctgccacttctgtgctgtgtgcttgcactcctcagcccttgggcggtcgatgggactgggtgccgtagagcagggagtggcgctcggggaggctcgggccacgcaggagcccatggcagtggaggggaggctcaggcatggtgggctgcaggtcccaagccctgccccacagggaggcagctaaggcccggcgagaaattgagcacagcagctggtggcccaggtgctaagcccttcactgcctggggcttgcgggccggcttgccgctccgagtgcggggcccgaggagcccacgcccacctggaacttcggctggcctgcaagcgctgcacgtagccccggttcccgcctgcgcctctccctccacacctccctgcaagctgagggagccggctccggccttggccagcccagaaaggggctcccacagtgcagcggtgggctgaagggcccctcaagcgcagccagagtgggcaccaacgtcgaggaggcgccgagagcaagcgagggctgccagggctgccagcatgctgtcacctttcaacatcagagacgttttcttctcttgggcttttggtgtgggactgaaaagtttccactaaaaacttgtgaccattagcctgccttcataagggtatgggattgtaatttatactacctgcatagtttaggaaactgcagacagaaaattatttaaaagcaatcaaataaatgttggcagtgctacaaagtacctaacagaaaagtgaattatcttcagagggatgctccttcaggtatgcccattgatagagtctaaatgaagtgctttcatattaaaaaaatatgagaaactcagcaatcatgagcaacagtgagcaggaaagacaaatagcagaattagacccctgtgaatgtcagatattgaaattactaggtaagacaatggagtataaatgaataaaatgtttcaaaagaattaaaagggaggggggaattaaaaacatgagcagggagcaaaatactgttaagaaataccaggtagatctgaaaaagaatctaaagcagttgtagaaattaaagatataataatgaccttgaaaaatattaaatgggttaagtagattgaactcagctgaacagagaattaattaacttgaagacagatttgaagaaagcccagatacggaaacatgaagatgtttagagtcagaagaataaacgtctaatgtgtatgaaattgaaatttcagaaaaggataatgaaaagactcacagttggtgtccaaagaaagaatgagaaattcccaaaattaaagtgtgaatcattaaactgaagaagtacgattaatgcagaggaaaaaaagtaactggataatactgaaaactaagagaaccttttttagcagccagaaacagattatctacaaagctatagaaattagactggcagcagacctctaaactataacaatgaatggtagagatcatagagctaggttttcaaatgctaagaaaaacaaatgtcatcctagggagagtaactggcagaatcattcagaaacaaggattttgaaatagatttttcagacagcatcagattgataaaaatctgacagtattgtgttggtgagtatgtggaacaatgggaactcttagacagctggtagaattataaacaactgcttttgagagtaattcagtaatgtctagtaagtttcagtatgcctttctccagtaacccaggaattctacctatgcatacatatatatcttagcattgtttattgatctcttttgaccatgatataactgagatcaaattttcgggaaacaaaatttatccttcctacaggcagtacattgtgatctgtctctgtacgtcatcactttgttcatcttcctttttcccctttactcccaagcattctcttttatttatttatttatttatttatttatttatttatttattaagctgtttgtgatcctggctcactaatgtgatattattgatgggttacaaactgcagtttgaaaaacactgccttaaagaaacaaacagaataaggatagggatattcatagcaatattgtgtgtgagagtgaaaaacttgaagtcatcttaagctctaacaaatggaaaatgggtaaataaactgtggtatatctatctaaggatcttgaactagacatcataataaatcattgaattacaatgcctatattaaatgaatacccttacaaatatagagtatagaaaacaaattacagatgagtatataatgtgatactcacatgaagcttaaaaaatgcaaagcaatggtatatatagttttatgagtatatacatatataaaaacaaagaaatccatggaaatgggctgggcgcggtggctcatgcctgtaatcctagcactttgggaggccgaggtaggcggatcacaaggtcaggagttcgagaccagtctgaccagcatggtgaaactccgtctctactaaaaaaacccaaatatacaaaaattagccgggcatggtggcatgtgcctgtaatcctagctatttgggaggctgagtcaggagaattgcttgaacctgagaggtggaggttgcagtgagccgagattgcgccactgcactccagcctgagcaacagagcgagactccgtctcaaaaaaaaaaaaaaaaaaaaatccatggaaatgataaacaccaaacttaggttattcctgggagtgaaaaagaaaggtatttctgttatccagataatttttttttccttaagctgggtagtggacataaaggtatttattaaataatatcttgtactcatgtgtatatctaaaatatttgacagtaaatttgtttgaaatggaggtggcagtattgacaaattgaaatttctcagaaagtacagcagaaagagttgaacattatgagagaaaagtttgagacctgtataatagatgtgggatatcagtatgtgtgaaataggaattccagaaataaaaaatacagtgcatgtagcagaagcagtagatagtaaaatggtagaataaatttgttctgagctgaaaaaagctttaaaataaaacctatgaaatcaagtttttggtaaaatcaaatatttataaaacttcaaaatttcaagtatcaaaagaaaatgaagttcccagataaacagcaggcgtacccctaacaaagaatctgattggcatttgatttttttttcttttaatgctgcactggatactaaggaagagtagaaacattcctatagaattctgaggtagaagtattgttaacgaacaccatggattttcatctaggtcctgctgctcactgcacagaaagccagtcagagataatgattattgccaaagaagaaggctttaatctcatgctgcagctgaggagatggaagatcagactcagatccatctccctgatggactgaaactagaggtttatatagcagggaagaaatgtaacaatatgcaagaaaacagtaactagaggggcaaggaagcaatcatgatgaatgaggagtccgctctctatctcattgtctggttgttgggatctggtgagtttcagttatttgatagtttttttgggaggcctgaaagtcatttccttaggaaggaactcagataaaacaaaaatgagtttcaagctttaagaccagaaggatcaatttctatgtttattaaaaaagacataaaaacccaaaaaactatctatgggactattgggtcagtttcagtattacgaccctaaagttctatgtgcaataaaactattccttcacgataaaggcaaaatatattctttccgaaggactgtgagcctataataattacatatttaaataaataaatatagtatttgggagtacttaagcaaaatgaaatgaattggaatggagaattttctggaccaaaaaaagaaaggtttatgttaaacatttgtgaacaaaaacaaaccaaaacccagtcagtgacatttaaggttaaatacaaagaattactaataatgtactttgaagtgtaatataatttttgagaaaatattcctgatataatgaatggaacttaggaaagaaatgacagctgagaaataaaattctaggtgacttaatacaagctgtcctacagcaagtgggagtggagcaaggaggggaaagtaaaagaatactgtctattcatggtatactatgcaaagagcttctatgcacaggaatggatggatattttatacttcttgatgtttatgacaaaatacaggctgaaatacgtgttgaaaatttgaggagacttttaaaagaaggccaacaatcaactcacccaaacttcctcaaacctgtttgacagaactaaaaatatatttaataaaaaaaaaaaaaaacaaaaaaacaaaaaagcctataacagcattaggtattaagaagggtgacattggtgcagcaaacttgggggaattccctgatgatagaaagtagatggactgagaggggcagaagaacaagaacagagaaaaccgcaactgaaagtgaaaagctcctgaggttcagtggacctcaaggaactctatttgtgttaccagtttgaaagaactggagtggaggggaggtggtgatgtgataatcagagtaattaattaaaaaactgcctctaggctgggcgaggtggctcacgcttataatcccagcactttgggaggccgaggtggacagatcacctgaggtcaggagttcaagaccagcctggccaacgtggtgaaaccctgtctctactaaaaaaaaaaaaaaaaatacaaaaattacgtgggcttggtggcgggcacctgtaatcccagctactaaggaggctgaggcaggaaaatcgcttgaacccaggaggcagaggttacagtgagccgagactgtgccattattgtactccagcctgggtgacaagaacaagactgtctcaaaaacaaaacaaaacaactaaactaaacaaacaaaaaacaaaaacaaggctggtgcggtggctcacgcctgtaatcccagctctttgggaggccgaggcaggcagatcacctgagttcaggagtttgagtccagcctggccaacactgcaaaactctgtctctactaaaaatacaaaaattagctgggcgtggtggcaggtccctataatcccagctactcaggaggcagaggcaggagaatcgcttcaacccgggaggcacggaggttgcagtgagccgagatcgcaccattgcactccagcctgggcaacaagagtgaaactcccatctcaaaaaaaaaaaaaaaaagctccaaactgcctgtagtagctggatacttcccttcctcgcttcctcattcatactgaatgatcagcagcagggtatttttctcaaggatagagtcatggcttctattctgcatatgatgattctggagaaggcttctggttgggattggaaagagcctgagaactctatcaagaactcatatgggaagaaggaaaggaaagatggctctgtatgtgtgtaatacatgaaacactctatcccaaaagtaaagccttccttattttggcagtcttgggggttccagcctataatctgctttgcaagcacacacactaaaacatgctgcttgatatgttttgcccgcattgagcctgaaatctgctctcccattcagggaagatggcttcagagacggacagacgtgtagatctataggagaaacccaggccagttagatagttctggaacactattcacaaatttggccaaggagcaccagaaaaccaacagtgcaaaacagaaagtgaacgaaggaaaaaactgacccctggaaagtgggaatggtgcaacaaatacatagaacttaaatataataacctcagagagatttcagagggcaaggtagctaaaaattcaaatcaggccattgtgaaagaagcaataggtgaagttctcagaaacgaaaaatctgattgttaaagaataatcaaaggaaggactgaaaattgaaacagtgatttagaaataaagttgaagaaacatactggaagctaaagataaaaagatggagataaaaaatatgaacaagtgtttaagtgacatggggcacggaaccaggtcttcagaggagacaggaggaggggagaaaagacgtaactaagtacaatacctaatgccgtggcgtattagataaatatttaaaaagatgagtgagattgaaatatacttgtgaaaagatggtcaagatatattaagtgaagaaggaagttgtgagaacagtatgcatagtatggtatttgtggttaaaatctatatgcatgttcaaatgtgtacaagaaagagtgaaaggatatgaaacactaataatggttaccttttgaggaaaggatggaggaatgagagaggaattcttttaaaatacataatgttgttttgaaaggaacatttttatttaaaaaatgaaagaactacaagttacattggagaggaagggaggagagcaacatgagggtagaagtggttacctaaataagccatttaaatttacacataatctccaacctatacttttctttataacatgtacttttctgttacttcttagcagttgtctccttcccctattattcctggacgtttacagaagtatattttcacacacttctctgaaccttcccttttacccaaagtatggtgggggtgagggtgtgactgataatttccttattgcacatagattttgtgagagatgatatagatggggagaatcacgtaaagtaaggatatctttaaattctaggtattggtttactaataatagtatcaacccatcatcttttttggaatgagtcagcatataaataaaataatgaatggtaaagagaaaaaacaaagagaattataaattcaaaaggtatatcctggtgggtatttttgagttgagattaggaattgattagtatcagaatagtaacatgtaagtataatcacagaggtttgtagtggtattctggaccacttgaaaggcccatcctttttgtgaggagatggatatgatccttggtttcaatatgccacatctactataaacttctgaaccctccaccatcattcaggatgcatctctcatggttgaagaagtggtggaggatggcatgggaaagagtgcctgaggatccttgcctggaacaagttatggaaagaaagtcttacaggtattcttcttacatattttacttgattgctatgtttttatgggacaaaatagttctctttcttggaagagtgggttgggagggggagagaagaggaagatgggtgtgttggggtagagcagtggccttcttttccaagggtggtagagaaattaggaaagaatattagtgtctttctgtcttttttctttttctgttcccgtacaacttttctgtcatcttcataactaagttgtatcagagttttcgaattgcagactcatttacatgataatatgattcatcaggaacatttaggtacacagcatgctgacataatagtattagctatcaataactcttagaaaccaatgggaaatgtttagatctgtgaattgtactaaattttaaatattttgaatatttttaatacaaatcttatttgtaactaacttgttgatgatctcttctttggttatgttaattggctatttaaccatttcacactctgatttatttctcaggcatgaagatgttaacaatgctgtgcgttttaattaagtagttaattaactggagctccctaagtcttaagttcctgatttttctctagaataccagaaacttaagtgccaagagctcagagaatggcttccaggacagctctagcctcactgcagcttaaaaaattgcaaacagatttttttttttgcaaaccatatgtcagggaatttctcagaggttttctaagaaattcttttatttgaagttttagaaacactatcttcagttgtattgctgataattcataattctgttgtcctttttaaatgataatataaaaagtatgcattagtatgtggggaagttgtttttgaaaacttacagcagttggaacttactcctgtaacaactctgttaagtggaagtaaacaaagataagtgagcataaaattggtcaaggtaaagtaagtgaaatgaaaccatataatagtagagtttttttttttcttttctgtttcagtgaaaataagtaatgttgctcttaagagagaattttgtattattttctcctcttcttttttttttttttttctagcttgggctctaggaaaagagccttttatcccaccttgtcttccagtccattttgaatcaagaaagactcattgaagactcctttgagaaaagtctgttttgaagaaggaaaaagaaatactgtttgagagaaggcaaacagacaaaaagggtgatagaaatatgtatttttgttgtatatgtaactctaagagaccttcctagagtgaatgaaggtagaaaactgaaaagggagtaaattaaggaatgattgaattttgtgggtcttgatggaaaaacgctggtcttcttttaatgtggaaaaacagctagtgcttcagtcctaggaattatgtctctgctgtgggcagttgtcataaactcttctcacaatccgagctgctctttgtcctctgtgaatgaaggtacttttgcttccatttcatccaaggatgaatgaaaatgtatagcatctgcccaaacctaaaaagtacagtgtgtttatcacgagagctttgtaaggtacttcacttccactttaaaattctttagtgctcaaaaccaactattgtgggtttttgtcaataaatactaatttttcaagatgaagtatggtgatttctattcatattgtggtcaattttctcaattttgtttcccatagatagcgtgatggaacttaaattttattttttacacttaaataactgtgctttttgtgatgcgtaatcatgattttctcttttccttgagattttaacagaccttatattagtgcatatgtcaaaataaaaatttttaaatagtaaatatgttgtaatattaaggatattgatttttttctattaaatgttgagcttggtgttggtataaaccctgatcctaaacggtaaattaatacttggaaattaagagtgtaactatgttatatagaaaccatcttgcgaattggtttgtgtgggtggtttttaaatttagtttttaatttttttagtatgtaatcgtactctttcaggattatctaaagcacttattgtaattggttgtttacttttctgcctcccccaccacattgagtggggaaataaaaccaaatgagtatttggaatctagtatgatccacccaatagtgaaagctaccaggatgggaatgattcctggagaatactggggaaacttgtagagtgtatgacaatttagcaagatgtataaggatgaggaggaattccaaaagcaggtggatgggggagctccaagaggggagtttccagctgagtgcaagttgtagaccatttactgtagcaacatcttagagtagaaggctggatggtagaagaggagctgcagagataagcagaggtagctagcacacagttatgagaagttggctggagaatgagatttggcaagtgctccatgtaatgaagatttgtttaaagaaaagatgtgatagaaaagggctgagttttaaactccccaagtttaagaaggtttgaagtttttaaactttaaaagtggccagggagggagccaatagagtaaaagtataatggtgagggttatgctggatgcaagaaattagtgtttcactaaagaagaatgttcagttgtgtcagatgtcacagagaggtgtagaaacataaaaagtgcaaggaatccttcagatttggtaaagaattgccactggtaaatttgtccagaacaatttcaatggggccagaaaactctggattgtgaagtactcagagatgagaacatgcaggcagtgattttattttagaagaattatttatctgtctttgcctttcatttaaaggcactttctcaaagttcaggttcctgactctatgatataattatttatagactgcctttctgaaaatagttctatatgggttaattttgttaatattagtatgttgacaaaagaaaacataaaggtcgatatgattattttcaaactgagaagctgctgtaccaaagctagtttataaaattagattttgtatttatggacttactcatctactatgttacagtagtctttgttttgtgaaactccaaggaaatattttctacacatttcaggttaagaaagaaaaacatgcgtttattttgtcttaaacatgaaataatgttttaagcattctaaaaagtacttacaaatggattaaacacattggcgttctttatagttttactctggttcttttttttgtgacttgttattcatagtctttgcaatgccgccctctagtgatcgatttccaaaaatgcattaattaacttgtaagcctgttacagtctttctcttttgactctactgatcctttgccacagcctttgtttggtgttctcttttattgctcttccattagttattcttattctcctttaatggcattagggaaagatcagaagtttcaggagcaaaaaaaaaaaaaaaaaatacatatatatacacatttgactatgaatccttaaaacttgtccatttaccagtctgggcatagggcaagttacctgtccagagttcttactgggaatgaatgagaatgtctttttgtggcacctgacacagacagcaaagagcaggcattcaacatataccagctgtctcttccaccctcttctccccaacattgctgagagtagggatcagtactgttttttttttttttaaacctgtcccttctcctcttatataacatctcaatttgttgtaattacctgtttacttgtttgtgttctataacttctagaggtcaggtatcatgtttggcttgtacatatttgtatctggtatttagcagaggccagtacacacagggtcctcattggatatatatttgttgaatgagtaaatgaattaatggatgccagtttttaataagaaccccagactgtgttaccgacatttctgttgattgattgattatgcagattgtaaatgggtaatatatgatataattagattttacccatgacctttcatagaggtatttatttcatgactttttcagtttattctatagttattggtcttctcaggttttggataatatgataatttgtgttttccttaagaattgtctgttttgttcagtttaaaaaaattattagcaaacacttatgtatagaattttcttatgatatttgacttccatatgtgacaaaaccccctttatcattacatttatgttatgtcttgtgttgtctgtttttagattgtaattagattggaggtatatatgtattttattgtttttttaaagcaatggccctttgaattttattcttctgcttgctaactgaaaaaataattttacctgttttttttgtcttccaggtttttctaacaacttagtacttccatttttctttttgtgcaaaagcttttattactctaaatttgcttctaaattacagatttgagtaaatgccatataatagaagatgctgtttttgttattttctagattttcaataaaatgtagctgcaatttcctcattgatctaaaagttacttaagagggtatttaaaaatgatgaaatgtatgtgtttacaattgttattttccatttttagtataatataatcagagaataaggaatgtacagtttctggtttttgagaattaaaatcttttttggtgatacatataagatcagtatttaaaatgtgccccaagcactgacaaagaaggtgagtcctctgaagggtatacagttttatatatttattcagatctctttttttttttatgtgcttcagctatcatgtatttatgataattttattaaagttttgtattactgttgtgtgtttgtcatttttctcattgttttttaacgttttattgctacattatttgattcttagaagtttgtgattgatatcttcataatatattttattcttcatcaattaaaaatattcaatcttttcattaaacattgcttatcatgtggatatccaaatgggaaaaacaatgaaacttgatccctgcttcccaccatgcacatttgattgaagatctaaatgtgaaaagtaaaataagcccctagaggacagtataagagaatatcttacatctttctatcagactgaaagtatcagtactttataatcttgaagtaggaaaatgtttcttaaacaggacacacaactcacaggtataaaagggaagattgataacctggactgttgacagttcaagaatttctgtcatcaaaagttactgataagagaaaaacaaaacagtaacagcagatacttgtaatatatatatctgacagatggcttatatccatactatgtaaactcctacatcagtataaaggacagacaacccaatagaataaatgggaaagagatttgagcagtcagttcaaactgtaaagacataatattaacactcagcagaatggctaaaattagaaagatcgacagtaccaagtattagcagaaagtggagagcgatgcacctctctttttgctgctggtgggaaaatataaattgtaaaaatcacttctgaaaactagcaacacctgctaaagctgtgggtatgtgtatacatacatatatccagcaacttcgataggaattcatgcagatacccactaaaaggcaagcacagtaacattcaaagtagcattatttgtattagccgaaacctggaaacaaaaatggccatcagcagtaaaatgggtaaacagattatggtagatttaattcagtgctgtatagtaatgcgtacagcaataaaaatgcatgaattgcggccccgtgcaacaacaaagataaattacatgaaccgatgttgatcaaaataaactagacacaaatacttaccgtgtatgattccctatataaaattcaaaagcaggcaaaactaggaatttaaaaactataaaatacaaaagcaggcaaaactggttattagacctcaggttagtggctacttttatggatgaggaagggatagggattgggaagtggtattgggcttctaggtattagtagtgttccttttcttgacttgggtggtggttacatgggtatactgaccttgagataattcagtgagttgtaaaatttatgatttgtgagtttttctgcatatatgtatgcttcaataaaactcaaattacggtaagcaaaaaatactgctttagtgtgaggatattattattaaataatattaaaataactagaaattcagtgaaacttaatcacgattgtattacctattgaaaatgtcagtgaataataccctctgctaattgtttgcctatatgttctcacattcagtcctacctcttctctgtcctctgtatggcagggtacatttagaaaaatacaaaaaaaaaaatgaaacttttttctcttatattttggttttgtttttattttcatttgttgattatatctttgccctctttttttaaaaaatttttccttatggagttttttcctatattgagagtctttgactccttttttctttgacttttactagaggagttctattcatttttctttttctttttcttttttccttttaccttttttttttttttttgagacagagtctcgctctgtcaccaggctggagtgcagtggcgtgatctcggctcactgcaacctctgcctcccaggttcaagcaattcttctgcctcagcctcctgagtagctgggactacaggcatgtgccaccacacccagctaatttttgtatttttagtagagacgaggtttcacaatgttggccaggatggtctcgatctcttgacctcatgatccgcccatctcagcctcccaaagtgctgggattacaggcttgagccactgcgtctggcctgttttattcattttcattcatattttaactgctggcttattcatttagtttctcatgcttcattgctgttatgcaaactgttttctttctacgtgtgtagagggttaactttaattctcctgaaaactatttctatgtttttcaaatatttgagcctatattttttgaattaacactattaaagatacattaatttccccagtttaaggtgaaacaatttaacttctcccattctttttcctctcacctctgtctttttaatgatgtagttcgtgattcagattaaactttattttcaattttttatttttgcattttgtttaatctcgagttaatttcagacatatgcttttttgtaaacatatttacaatcattattcactcaaaaatttattgagcacctactaagcaccagacactgtcctaggcaaataagaatataagtgaaaaagacaagacccctgatctcatcaacttgttgatggtcaaaaataggtaaataagatgctttaaattttgaagggtagtatgatgggaataagtagggtgaagtgatacagaatgaatgactgcagttcggattaaggctatgttaggttggtcagagaagtcctttttgaagcagcaatatataagctgagacttgaataagatgggacatgaagctgggtggagtggttcagggagaggggttagccaatgccctgatgaggtttcattttttggaagaacatttattcaatattactgattgaattttgtcaggcatttgagatagtcatgaacgaaacaggatttttgctttcaaagtatttacattttacgcagaacagataaatagatgagcaaataatttcagaatgtgataagtgctataaagaagataaaatgctagaatgaggagaagggaccactttaggtaggataatgagggatgcttttctgaggaggtgacatttgaattagtaacttggaagtcagtaatagacccagacatgtgtaaatctagggaacagcatttagggtagcgttttagttgggttggaacaaagagggtgaagatgggttgaatcttttcgacccttacgtgcttatgataagcttagaacttactctaaatatggtggaaaactataggttatgactacagattcaattactatagcaaaagatctttaactatagagcaccaaacaaaattgaagttactttcatataactcagtccaaagctggtagctggctattttccttccacaaggttgtctaaagactctggttccctctatcttagtctttaaccctctgataagcagttacctgtgtctatgtggtccaagccacttcgccatttacagatccatgtttctaacttgggaaaggggatgaaaggctagcaacttaaggaggaagggacagaaatttttgcatgtaggagtggaaaacattaccagaccttttagctttgaggaacatgttaatttttttttaaggcttccattaagaatgttgatattcataggggacacctaggtttcagtgaaatcaagaaagtcaaggaaacattgagagaataggctgaggagatagacgacatttctgatctcagataagtagttccagaaggcatgcacagtgaaatcatttgagacctgggatggaggatgggggagattcgtaatcttctttgtgctcagaaagagaatctgaatatttttgttaacagtttcagtgccagtccacttatgctattatgttatttctcttgggttattgtgacttatttatagattggctttgtagtttcttttaacagtatttcagatgtgcataggactggtaaaaaatgttgagcttttctgtattttggccagctgtgaattcattgagtatagtctttgtccctgaaacttcaatagcctttgtttaattgattctaatatttgaattagttgacagattttaaaatattcaagctttatgtccttaggtacctcgtgtcttaataatatagccatgaaaatattaacatttgtaatccttatacactaaacaaaaaaggggggagtgtgtatataataaagcatgttaccttaaagctatcacactgattgttttactaatcatttgtatatgtatatacaccatagaagtataaacaacatgcactctcacactgaaaagcattgctaaatatgatggtttctcctttgaaatgtactttgagatatttttgcatgtaggtacactattgattacatcttctattaatagactattccactgaaataagttggatgctggaaaattctgtttaaatttgattagatacttgagttgaatgaatttgtttaaagttctttttaaaattgcatgaaaatatgtgaaaaagtttaaaaataatctacagtattttggcaggataacaagaaataaaatttctttttaaaaaatgtgagttttggtaaatgtttctccttcaggactggtgcttctaatacaggttggtggttgtgcatatatttatggtttcacatatcagtactcaaagtctgatcataatcatgtaaaaatcattgaaggaaaaggttgcgagggtgctggcccagagtttcaggaaggtgtgtacctaagtactctaggacagatgtgtatttccactaaatatcttagaggtggttatttcataattttccttaaattctgtggattgatgacctcaaaaataatgatgtataagtatagttatggaatttagcattaccagcatcttaagcatagctgtagttacatatccttccatgtttgtgacaacatggagaagctcgtgaagacacactgagtcagtaagctgatagctcttactttctgtgaatatgtgcatagtttacaaaagtctgttgggcttctgatattaaaattatgttagtgaacttatatataaaataatttgaggagtggtcctccaactttaatgtgtttaagaatgatcttacaacttgctaaatcctgatgtcttggcccttgttccaagagctttgcttggttctgtggaacacacttgaaactattttagagattaaagaataaaaaatagaagctttgaagaatagtgatctgtgaagcaggaaattaaaatatcatgcctaagtcattaacatttctgcatagaaatttgcattagtttgatataagcctttctattattgttcactaaaatattttaagtgattgactttgaaagtgtcctttgttttagcttctttgttccattctttcctgacatgttcccttcagtcttcttttactttctttagtaaatgtttgagtgtttaccatgtgtcagtcattgtgctaggaatcttgaaggactcaaatacgcaaaacacatggatctagcctagaagttctcatttcagagattaagcgtcatttataaaacaagtgataattgtataacatgttgaatgacacagtcattcagagtagtgaaaaattcacaaaacagctttgtagtagctcctaaaatatgaataggagtttctcaaggggacagaagggaaatggcattccagttagaacaatatttgcaaagacatggaagcattaaagagacatttgatgagatcaaggtggtgggtaagttgtagaaaaggaggctataaaataggttagggccagagacttttatcttttaatttattttactgtttaacttatgccaggggagttgcagtgaatgtcacggggagaaaaaaagatatttcaaaagtagaattggtaggatttagagactagttggatgtgacttagagtttaaagttagaggagtcaagggtgactaattggaataattaaggaaaatacagaatctaatgaaatctgacttctttaattttcaattatatttggataaacaaggacctttaaatctgatagcctcttttcagggcttattcttcctgaagtcatcttagcatgtgaacattacctcttatagtctgaagccacatttgtttgtttttccctcagccctactggtgaaactgtacgatcttgcagtctgcttcaaaagcctgtgtgtgactcagtcattctactttaggaattgaaaccaaagaagtgatcagagatgtgttccaagatacatataaataggtctttatattatagtgtttttatgattaaaaaatgggacatggcttaaatggctttcaaaaaaggaattgatttaatttttgtatatctaaggtactgaatgggtaagttagggaaaggctgggctattgtaacaaagagatttactaatgattccatggtttaatttaaaaagatggaaatttatttctttataggggaatgtttcaggtcaattagaaattctacttctgtggtcattcagggacataggctctatccatcttatttctctaccacctcgtggggcattaatgatctatgctcaattttaggcacatccatatgctggctttattgaaactgttcttgccatggttgccagcaatgacacaggttgagtatctctaatctgaaaattcaaactccaaaatatgaaactttttgaggggtgatgtgacgccacaagtaaaaattctacacgtaagtacttaacataaactttgtttagtgcacaacattattaaaaatgctgtataagatgtatatgaaacaaatgaattttgtgtttagacttaggttgcatccccaagattatgtgtatgcaaatatttcaaaatctgaaaattttgaaatccgaaacatttctggtcccaagcttttttttgagacagggtctcactctgcagcccaggctggagtgcagtggcatgatcttggctcactgcagccttgacctcccaggctcaggtgatcctcccacctcagctacctgagtagctgaaactaagttgtgtaccaccacacccggctaatttttgtatactttgtggagacagggtttcaccatgttggtcaggctggtctcaaactcctgggctcaagtgatcttcccacctcggcctcccaaagtcttggaattatacgcaagagccactgagcctgtcctgtccgaagcattttgaataagggatactcaacctgtaattaatacatgaaataggcatttcagtgcttctgttgtttcactgtgatatttgaaactgctggccaactttctcctccgtgggcttctgctggtttctcttctgtccctctaagtatttgttcactgtgtctttttcatgttcttttcctttgcccttcctataaaggtttttgttctccagttttctgtctttggtccgttttcatttacatgtgtacctatgttgatctcacccagggccactaccacatgatggtgtctcctaaatctacatctctagcctgaaaacctttgttttgagcatcaagacctgtacatgtaatgcctctctacctgagtactctgcaggaaattaatatgtaacatatccaggactgacttaattatcttctttcccaagctggctctcgcacctgcattacctctcatagcctcctagatcagaaaccaggaagtcaacctcagcaatttcttgtcctccctcttccagtgagacctcaacactttattaaatatgcctcgagtattattgctgacattttcatttttctatctccattgccacagtcttagttcaggcgaagattattttaagagcttcctcagagatctgtgtttccatttaggctccctttcaatcctacttattggttaaatgggtcagtgattttcttctactggtatttggtgggcagcagctgtagttttaaattgcatgatatctggcccagtgctgagtgcagttcagctgttaatacgatactaaatgaagaacatttgtgaataaagacaagattagtaatgaagtaattattaccataatattcaaagaaatctggaagaaaattagaaactactttcacatcggtagggaaaaagtactagagccaaagaaaatgattttggtattttactgtttaagtttacatacaatctgaatcacggaaccaaagacatttgttgcagagattagcattatttaaggaaatcaagaacaaatagttcctgaactcagtgtgtcagttcaacctctgcacctttgaatttggctggactcctgtgggtcctaccaaggctgcacgtaacagaaagctatagacttccattcctgttctggccagttaacttaaattctttgtgtgtggacatctgacacacctgtttgattctccctcttggtgttaggactcctcgcatctgatctgtggtgatccttcacagtctctctcgcaatttctttgactgttgtataactctgcagtccttaactatatttgctcacctaattttttagtgctttctgagcttcaagtaagaagctttcttctttatttcatgcttcttggttgagtcatctctggcttacctggcaggagaaaggagtatttgggcataattagtgtttttacaaagtatgtatagggtattgtgctggctggtatatatggcagaaagaagtgattctgcctcaactcagattagtaataattctcctcctgccagttgacgtttattgtgcttttactatgtctagggcactttctcacatgctttactatgttttaatccatttaattctcacaacaatgctgtgagagaggtaatatccccataagtggggaaactgaggcctagaagggttatatttgaccagtaccacagagctagtaagcgacagagttgagattcaaatcggcataatgtttccagaatctgttgcctccgttttttactgactcttgaaagaggggttaatatggtacatgcatagctataacacaaacagagatgctcttttaaataacattaagttacaagacaacatgcaaaatacgtgagtcgtcattgtggagggaaaggaatattggactgccatccactagttctgtgaccttgggcaagcaacataacctctcagtactttagtttcattatccatagagttcaaaggtcttttgcaaaagttctgtggattacatttttttttctttttactaatttaggctttgtttccttgttgtgtttagatttaggtatctactgcagattaaattacatcttttgaaaattttgattttccacttaggttataccagtgagttagttatagctttgtatgtgatactgtaaataactccattatttgtgctttattatgtgaatttggacttgtatagaacaaaccaggtcctcttaagcataaacacattctgtaatcaatcaattctatatttattgggcatttactatatatcttattctctgctagaccctgtaaaatcttggtatgttagtcaatatattagctttggttctgcactcaagaattcttacagaaatgttcactgtttggtattttgatacatagtcttgaaagtctgtccatttttgtgaaatggcaaaatatcaaaatgacaacattttaaaacattttatttttgtgtcagagtagagacaaacactgatttcaaaaatttcaaaattttacccaagacccacagtaagaaacatatgacctatgtgtgtctaatgtatatgtaacagacaaaattttcatgaaacaattatttactacatgtgactcactgtaatactttagttctagtctatactattttgtgcaaatgttcattgcagtctatcaagttaacctcacaggttctaaagctcttaaccgacaggctgaaaatcctacacttgactgataaggcaaaattatgaatgctgttgttttagtgatttttttttttttttttttttttgagacagagtcttgctctgtccgcccaggctggagagcagtggcgccgtcttggctctctgcaagctctgcctcctgggttcataccattctcctgcctcagcctcccgagtagctgggactacaggcgcccaccaccacgcccggctaagttgttgtatttgtagtagagatggggtttcaccttgttagccaggatggtctcaatctcctgacctcgtgatccgcccgtctcggcctcccaaagtcctgagattacaggcgtgagctactgcacctggcctgattttttagtgtttttttttttttttttttgagacagagtcttgctctgttgccaggctggggtgcagtggtgctatcttggctcactgcaacctctgcctccctggttcaagcgattctcctgcctcagcctccctagtagctgggactactagtgtgcgtcaccatgcccaggtaatttttgtatttttagtagagatggggtttcacatgttggccaggatggtcttgatctcttgacctcatgatctgcccgcctgggcctcccaaagtgctgggattacaggcatgagccactgcactcagcataaaaaggtttgtgttttgaatgaacatttatttccttttttataaatgaggatttcgtacattttactaaaagggcagaaatgtgcttctccttttctttgaagtataatcttttgaactttatttttacacaagattacttgaagaattaggttgcattattatataagctttagactgagtcatactgtgtattcatatcacaattttttaactaaattgttttttagcagattatagcagtaggataaaatgcacatttttaatgcctgagctcccatcccaaacagcttcacacatagtctcattaaaataaaaaatcctgggagagtgaagtgtgtccttatttaaagaacttctggatctatttttacccttgtgaggctgattcttatgaggcagtttgcacagtgactcagcacatgggttctagaatcagacttccattgttcaaatcttagctctgtcagttgtaagaccatgggcaagctagttgattgatctctctgtgtctcagttttcttgagttacctcaagagggtggttataaccattcaaaatattaacatagagaaacaggacatatagatctataaaactcgactttattttaggaaagggtagaattaggatgtctgcagatggctccattgttcgttcttaaagatacaatgctgaacgctctcatgcgcatgatttttctcttgagtgctcgcccttccaattcaacagctcacttatttaattggcctaagacttaattcccctgcctctcttcctagctccaactttcatgaagcttccttggataaaaatcttagcaacagattatcctctcgcaccccccaccccccctgtgctccacagtttctgagattccaaactaatcctggcagggaaaatcaaggaaaccttcatataaggatctcatatttgagtgtaagctcacctgagcaggagggcattccaggcatgatcagcttgctaagtaatacaggaaacaaaaagttcagccagaatacgaactcctcattctagtagaatgatgataaaacatacacagataacttcaatactgtgaaggatatgataaatgtcatgaggatgacccaaagtgctttgggattcagagagtgagaagtaacattcataggaagttttatgaaagtagagacatccaggctgttttaaaggatagttaggagtaccagagggctttagggtgggatgaggatgaccaggcaaagggcattctaaagtcacaggggaaggaaatagaggatgtattgaggaaaagtgagaattcacccatgatgagaaatatagagagtaccacagattggggaataggggctgataagattggaactatccaggttttaaccaagtgatggaaagccttacatggtgggctgtttgggatccattaaagaacttacaagttaatagcttttgcttgaattctgcccaaagataaattttttaacttgaccagtaccatgttgcttttaaatggcttttttttgttttgttttgttttgttttgagatggagtctggctctgttgcccaggctggagtacagtggcgtgatcttggctcactgccacctctgctgcctgggttcaagcgattctcccgcctcagcctcccaagtagctgggattacaggcccccgccatcgtgctcagctaactttgtatttttagtagaaatgggtttcaccatgttaaccaggctggtctcaaactcctgacttcaagtgatcagcctgcctcggcctcccaaagtgctgggattactggcatgagccactgtgcctggccgttaaagttcattttaaatttttattttaaattttagtatttaaaaatcaggggattttacattacaacttagatttcctttttttcctgtaaaacggagatctgaaagtacaaggcccacatccctgcatgacatgtgagcagaggcaacatcctttggacagggcattctttgctttcagatttacaacacagtatatttgtatatatttataccaggctggcctccctcagttatgttgcctgtctgtctcctataggcatttggatattagatttctgcagtagagaaatgtattagaagtcaaaaatagttactgaaatggcattaaaaaaacagccagtatgaaccaagtttccatcagataaaaatatatcccaaataaatatttgcacatcaagcaaaactgcaatcaaaacaaatattgggatctagtatgcagaaaattcaggaactcagaatgtgcttagtaaatggggccaaaaagatccccaaagaatgtcacttccctgtgtctatgctcctatttactgctcttccaatgactttgggcttttccatgtgatttactttgaccaatgggactgcagcaaacatgacccaaccagaggcttaaagattgcttgcacgttggtgtctgtgctcgcttatcacgcaaagccctggctagtatattggagaatgagaagccacgtgaagcagagacagaccatcccagctgaggcccctataccagcctgactactgccagccagatgtgagtggggccatttagaaccatctagccttagtcaccccaccagctgactgtagaactgcctggttaaccacaagctaatgagcaatataaaggatgttgttttaagccactaagttttggaagggatttttgcacagcaaaagcttaggaggaagctttgaagatgtagcccaaaaatgacgttgtaaacctccagcacactagctactattaattagcctacgagagagaatcttctaatataacatctataatacctaagagaactgaactatatatttgagaataaatggatatgctggagtatagaggggtttgtgtgtgtgtgtgtgtgtgtaatctagaacaatgatcagataggagatggaggtgtggagattgactggctggtttcaagaaatgatctcagaaacagcttgacccctgggattcctctagttccctgattgtatatccgtaaaacctcttaccgaacccaaaattatttttctgatcatcttgataatacatttattataatttcatttttacattaatttctatagatatttgtggggttttcttgggatggtatactactaattatttggtttttcttttggggagcgggaatgttgatttaaatctgtatccacatggctggattaagactaaactcacttttcaggcattctcaaaagggaggaggttcactgacagcacgccccttctgatatcattagacaacttactggtacccttggtggcttctctgaatcctgtctatgggtgccaaaatacagggatttcaatatgggggaaagtaagaatttggagtattcccaggcattttgtgtgaatatctcccagcatcttattcttttaagtgtgacggctaagggatcatcaggacctactgatggtcttccagagatcatcaaatctggctaaatcttcaaagcttcctcctacagttagcttttgctgggcaaaaaaacccttccaaaacatagtagcttaaaacaacatcctttatattgctcagtacctggtgatgatcccttagctgtttatcagatgatcttcagggagtttgacagtcccatagggaaagtgatgaaacaattttaaaacgatatttaagaagtttgaaatgtaaaatatacttatgattttaatgaaaattctgttatatcctcaaatggaattataatcttaaaagttatgcttttgaaataaagacagtattggccatttcatcttgtgttttttttttttttttttttttttttgagatggagtcttgctctgtcgtccaggccagagtgcagtggcgcgatctcagctcactgcaagctccgcctcccgggtgcatgccgttctcctgcctcagcctccccagttgctgggactacaggcacctaccaccacgcccggctaattttttgtatttttagtagagacagggtttcaccatgttagccaggatggtctccgtttcctgacctcgtgatccacctacctcggcctcccaaagtgctgggattacaggtgtgagccaccgtgctgggcccgaccatttcatcttgattaaaattgagttaacagagtttgtttctcctcgtctgcctcatatcgttagtgaattatatcttttgttaaatttgcttttcttgttccaacaggattacatgatatctctacctcataaaatgaatcaatctatctctaatgtggcttattgatgcctaaaatagaggtgaaatagtaacataatgccagaactcagaataaggtcataggccaggtgtggtggcttacacctgtaatcccagcacttttggaggccaaggcggaaggattgcttgaggccaggagttcaagaccagcctgggcaacttagtgaaactttgtctctacaaaacaattttaaaaaatcagaataaggtcataaatataaatactaaacagaatttcagtgtaaacaaagtagtatatgtattgggatatgaatctctgagtttgatgattttgtataaacaagcaaagaagaaaacataaatagaagatacatgattaatatctgcaaatttgattttatgttattttctagtacttggtgtgttgtatgttataaaattttgtcaaatagtagcagaaactactgacacctttgtattgctttcaaagtatcataactactctggaaaaccagttatgtttttttcctctagggcaaaggcaagtaatgctttttcttggtgtgtgtgtgtgtatggggtgtggtgggacagggatgaaattgctgcattttgccactaaaggaagagataggacttagacagttcattcacagatggactctttgaactaaaaatggtatatgagagcctgcatagcatgttgatgaagatcatgggctgcctgggttcaaatcccagccttcttacctgcggagcatgttgattgattaacatcatgggctgcctgggttcaaatcccagccttcttaccagctgtgtgtacttggtcaaaccacttcatttctgtatggctcagcttcattttacttattgagggaatagtagtaatatgtactatatatgtatgtttgttatgagaattataggagttaatatttgtaagcattagaagagcatgtagattggccaggcgcagtggctcacacctgtattcccagcactttgggagctgaggtgggcggatcacgaggtcaggagatcgagaccatcctggctaacactgtgaaaccctgtctctactaaaaatacaaaaaattagctgggcgtggtggcggacgcctatagtcccatctactcgggaggctgaggcaggataatggcgtgcacccaggaggcagagcttgcagtgagctgagatcgcatcactgcactccagcctgggcgacagagcgagactccgtctagaaaaaaaaaaaaaagcatatagatcatggtaaatgctatacaaatattaagaacatgcattagaactaaataaaaatgtctatgagagggaaatgttttttataaagatgagattacgcggctgggcatagtggttcatgcctgtaatcctagaactttgagaggccaaggcaggtggatcacctgaggtcaagagttcgagaccagcatgactaacatggtgaaaccccatctctactaaaaatacaaaaattagccaggcatggtggcgcatgcctgtaatcccagctacttgggaggctgaggcaggagaatcgcttgaacccaggaggtggaggttgcagtgagccaagatcatgccatcacactccagtctggtgacagagtgagactccatctcaaaaaaaaaaaatgaaattatgattcacgcaaatataaaatgagcacttatcaacacatttaactttggttgaaaggagaatttaaagaaccatacatatataggcaataaagaatactgaaatgaatttacaagtaatgtaaaataaatgaaaataaatataaattgtcctcaagataatactcagttgtattccagggaatataattcatgtgcatttatatggacaataattcacattattatccattttctgcagcttacagagttttaaaatagctcaaagacagtgaaaggtagagatcaccgtgataggtaagctatacaggacacccactaatttcttggagtgagctcatatcgaaagtttttcacattttctctgacatgtattataaacaattataaatgtaatcattataaacaattataaaaccagtgcaaacttaataataaatattaccctcagaggaggaagtagaagggacatactttttccccaaatatgactttttgaacagcatatgatattgacaaagactgtctctttaaccaaactttagttaggtccctctggacaagcccttttcttgtctagaccctgtccttgtcagaccttcgttgtccagtttgagcaagaatcttgctaagtcagtttagagagaatctcctatcccaaatatctaacatttcggtatctgatcaaattcctgatcccccaccatcccccaggcaacatatgatcatactggcctaccttcagcaagaatcccatcttacccctagtgtttcctcttagtgatttttccatccattgaccccatcctgccccttggctataaattcccacttgttcctgctgtatttgaaactgagctcagttcgatactgacgtctcttttcctctattgtaatagtccctgaataatgtttttactgctttaactgctgtccagctctagttcctttaacagttaatggtcctgtgatacgggtaggattagatttattattggattcctggatctctcatccaggactcagctgtatacctttgaagcctttgtcttcactcctgactgattgatctgggatctgttgatgagtctgactcctaaaccattgccctacatgacagttcactgaagcatggtaggaacagatattcatacttaagattctgagtttactggttgaagttgggttagagacctatgttttttttgaaaggtactactgggctggtagtctttcttcatggcttttggttccaagtggggattcacatccagaatcctgagatggaaatggtttctcctggcactctgtgaggtctccctgttctgtttgaacatgcttctcccatgggaacttattagttgactgaaaccctcttctcaaggttctgctgactacagtagtctcccctgatccttagttttgctttctgcagtttcagttaccagtggtcaactgtggtctgaaaatattaggtagaaaattccagaaataaataatttgtaagctttaaattttgtgctattctgagtagctttatgaactcttgtgctatctactccatccttcctgggaagtgaatcatcctttttcagtgtatccaaattgtagatgctatacagccattaagtcactttgtagtcatctcagttatcacattcactgtctgtgtattgcactgccggtgttcaagtcacctttattttacaaaataatggccccaaagcacaagagtagtgatggtggcaatttagatatgccaaagagaagccatgaagtgcttcttttaagtaaaaaggtgaaagttctgtactcaaaaaaaaatcgtatgttgagatttactataagaacaaattttctatgcgtgaaattgtgaaaaaggaaaaaaatttgtgctagctttgctgtcgcatctcaatctgcaaaattacagccactatgaatgacaaatgcttagttaccgtggaaaagacattaaatttgtgagtgtgagacattaatagaaatgtgttctgactgacaacagccgagtgtaatactatctgcggtttcaggcatccacgaagggtcttggaacatattccctgtggataggagggactactagtatgtgctcctctaaatctgtttacttattatttgacaaggataatttagaacttcactggcttctctaggaaacttaagatctttccaaagtggctcctctaagacctctcccttcccattgcttctgctcctccttctccccttgccatctttgatttcccctttaattctcttgaatcttttgatgtttcccttcaaagccttacctctttcatcatccttctgtccatatctgccagactttttcttccctacttcagcttctcagctccctataggcacttgaactttaagcacactgtccctcgttgaaggttttcaagggtctcaaggatccccaaaagcaaccacctgaggctataaaggaaaaaacactaattggaaacactgaatattttatccagtcagatgggctttggagacatccttaaagctgttcgatgtcacctcagttactgcctaaaatttggtccacagcctccataagattacatgggaaaatcttaaaaatcttctctataaatattattaaaaaacattaactctcatatagaacaggtaacctaatttgttccatttatcaagaatacaattttgacaaaaatgtagaccaaagataaaactatattactttgtttacttgattaattgctaaagttttagaataaaagctgtaagatctgtttgcggctatctgcgtatttgtttgtatatgtttatgtatgtatgttatatatatgtgatatttttctacctaaggatagtattaccagcataattcataaaatctcataaggaagcactattcaaattatcttagagattaatgaactcttatataagttaaatattccaaaaactcccagaaatgtggaaactaacccaaatgtgttttaaagttcatacgggctggatgtggtagatcacacctgtaatcccagcactttgggaggccaaggcgggaggatcacttgaactcaggagttcaaaatcagtctgggcaacatggtgaaacccatctctaccaaaaaaaaaaccccaaacgcacacacataaaaaatacaaaaattagcctggcttggtagtgcatgtctgtagtcccagctactcaggaagctgaggtgggaggaacgcttgagcccgggagttggaggttgcagtgagctgagatttcaccactgcactccagcttgggtgacagagcgagaccttgccccctcaccttccaccccccaaagaagtacatataactttgctaagtcttcaataaataagattaatattattggtttaataaaaatgggtttgtcttaatgacttgtcagcgttaagtataatgtgggcatgtttttattctacttaggtttgctgatcagataaacttatgtctactagatatttaagattataaaaattataaatttcacctaagaaccactgtacaagtaaacatgcactaacattgaattgctttatagccatgacttcttgtatatcaagcatagcagtaaaacaaaaatccatgtgtttaacttttttaggtttttgcttttataatactttcctaataaatgcatatgttgtagaaatcgttaacagggaaataacttgagatgttggctagctttgtttaatgttatagtatgtctgcctggaaattgtttttaaaatctttttagtaatttgcaaccttagacttacattacattacattaatagatattcattaaaatctacataatttctaagaaatataaatgactgaaatactaatgctaaacctaagtttgagtttatatactttggctttttattttcatatgacataaagaaactagatataattgggcctgttaataaaatgttcttctgaaagattacactataaagaaacaaatatctctaggaattgtaagatgatatactcataaaacctgctagtttgctatagaatgctagtatgtgacacagtttacagctgtctccttaagttttctttgtaaaagtgtattggtcgttaaaattacatttaatacatgtaagttaaactactaaaaataataagtgtgaggagaaacaactctgtatgcaaagtatgtgaggaatgaaggacttttttttactgttgataagggaaaaagagtgtaattttgtcttaaaataagattactggttattccagaatgagaaagaggaaaaatgtaggacgaaatctgaatggatatggaaaactgtaggtttgcagaaaaggaattctttatgttttcaagctggctatgattaaattgatttctatataaagtttttttttaaataacatcagcccaacagtgtgctaatataaaactagaacttggttttatttctgttaaagcaacaaagttttcttggaatattggtctgttcttagtaagagactgtgaaaggtttttcttttttttttttttttttcttttttgagacggagtttcactcctgtttcccaggctagagtgcaatggtgcgatctcggctcactgcaacctctgcctcctgggttcaagcgattctcctgcctcagcctcccgagtagctgggattacagacatgtgccaccacgcctggctaattttgtatttttagtatagacggggtttctccatgttggtcaggctgatctcgaacttccgaactcaggtgatccgcctgcctcggcctcccaaagtgctgggattacaggcgtgagccatcgtgcccggccgcctctttaccttttaagtaatctgcctagggaacaaaaattctgtgccttatcaaaataatttattgtgctttgtgttttctatgtcatctccttttaagagaacttaactattgtttcatagttatcgaggatcctgtttaatcagcattcaaatcttttgacatttttgagttttccaaaatcaaattctaaatgaattctttttttgtttgtttgtttgagatgaagtctcgctcttatcccccaggctggagtacaatggcgcgatctcggctcactgcaacctccacctcccaggttcaagcgattctcctgcctcagcctcccgagtacctgggattacaggcgcctaccaccacgcctggctaattttggaatttttagtagagaagggggtttcaccatgttgaccaggccggtctcgaactcctgacgtcaggtgatccgcccaccttggcctcccaaagtgctgggattacaggcgtgagccaccgtgcccagccctaaatgaagtattaatcttggactgaccttgagatttcccataggtcccctggaaaatgtcaaaggattttttctttcacctagtaaaaattttgtttgtttgatatattaaattatgtgggaaacattgtcaagtaaaaagtgatgcttaagcttttctaggttatatttgtatgggtaaatattaataataaaacattccagaaattatgtgaatttcatagacatttgccaataccctcattgtccatcatatgttctggtatatactgttatcatcataatgccaactattatttaaatatttaaatattgtgtgtcacaaaaataaccaaattccctcaccagttttatcatttttataatgaacagatgtttaaccacagacattttaagtcttttattatccacagatagtttttcttttactctgattcttcctgaaagcttccataatcagcttataagccagaatgcttcattttcaacaaaactgattgtctcagagacctgtggaaaggactatgccaggtactctggggtatagccttctaatggcattgcttagatacttgtagaccataccattggaatgagtatggatttctgcagctagtagagaagctgacgggttcataaaactgctaacgcaggataaagcagaagattcaattacatggggccgaataaactaataaataagataatttttatggttattgttttggaatatttatcattctttaatgtcttatttaaggagactttttttctgttgtctcatgctttctataactcatgacaatttagtaggttatgcttttgtaaaaagagatgaaacatattttcttccaacctgatccctccagaattcagaaacacttactgagtattcttattctcaatggcaatacaattatttggataagttcaataagattctgtcttccttgtaacagggcatacttggaaaaatcagtttataaccaaggctttgactggaatgtcatatttgagaatgatgcattgaatcagatacgtccagacagttttaaggcacaaagactttatggagtcaatgcttacaaagtcctcttgggaaaaccggcctggtacctggcttattgggcaggggttcccaatccctaggtctcagactgggccatacagcaagagttgagcagcaggtgagccagcatcttccctacccccagtctgtggaaaaattgtcatccacaaaactggtccgttgaaccaaagactgctgttatagggttcccagccttataggtgggtaaggaaggtcacttcctggcaggtccaggaagcttaggatattttgggaacctcacaagagaggaattcacccaaatctatagttcttataggaaaaatatggtagtgcttggcttgacttttaatcttcaagaggcttttagaagcctaatatgaaggtcaggcacggtggctcacgcctgtaatcccagcactttgggaggccgaggtgggtggatcacgaggtcagaagatcaagaccatcctggctaatatggtgaaaccccatctctactaaaaatacaaaaaattagccgggtgtggtggcaggcgcctgtagtcccagctactcaggaggctgaaggaggagaatggcatgaacctgggaggcagaacttgcagtgagccgagatcgtgccactgcactacagcctgggcaacagagtgaaaccccgtctcaaaaaaaaaaaaaaaaaaaaaaatctaatctgagattcctcataaaaaattccagtaaaacaaactcaaaaaggcctaagtggtcatttttgctgcaattatgtaaataaccaggccaaatctaatgagaccagacttattttgtaaacaagagttaaaaaaggaagtgagtggagagaaaatttatgcttaaatggaaaactatagtgtacccttgtgggttattaaattctagtcctgttcattttttttttagctttccgttgtcaacctataaactggactggatcctgccatcttatgcattttctcaattattctagtttcctctgatagcctactacaagtttccaaactaacatttctaatttttccccaccttcctcacttggcatcactgagaactaaaactatgcttttcccaaagcccaggaagctgaagctgtaccacttggtataagctgaagaaatcaccacaccttttcatgtatgggtaacttcatgagaatctcttctttccttgaacaataagagggactgacaaagtctgtcttcttaagcaaactttaggcaggtttctctaagcctttttcttgtctaggccccattcttgcaatacctgcgtagcccagtttcagcaagaatcttgctaagttagttaagagaaaatctcttacccttgatatcagatcactcttgatacttggtcaaattgctcatcccccaccaggcaatatgtgatcaccctgacttgccttcagcaagaatactgttcaggctctataaccagaatccccctatatttcctcttagttatttcccatccactcacctccatcctgctccttggctataaatccctgcttgttattgctgtatttggaaatgatcccagttctatactgaggtctctttccctttattgtaatagtttctgaataaaatctgtttttactgctttaatcacttccagttctggttttctttgacattatcagaaatatataatatgaaagagcaattactgtcatgtgtttacactgacagatatttcagcttgcaattgtataaaaccagtgatgtacaagctgagttggtgctttgtgtacatagagaatgtccatgagggcgatatacttggcaactttttgtcttatttattactgaaaacctagggtatggaaaaagatacattgagatctgtgtgtgaaaaggaaggcaaggcattgctatgcaaataaaagaggtggcctctaagtggtaatttatattgttgtatttgcaaagaatagttggtggtcaaaaatacttcattaggttttgatttactgttgaaggaaatactgctaattattagtcctatcaagctgtagcctttaagtatgtacatatctttttggcatactatgtgaggaattgggctgtaagtataatctgactgttgaggaaaaaagagcctcatgttagtttttaaaatgagagacaatgaaaatattccctcataatgctgataacttgagtaaagaccattttgagtaacttatttgagcaacattgtcacagcagtatatttattcaataaatatactgaattgcttgaacctccacttcagtctcaaaatattccattttaaaaatttgcagatgacagattagagtttcttttgaaacaactgaacggtggtataaaaatggtttaaacttcaatgttttcccatacctttctttttttttctttttttttttttttttttgagatgtagtctccatctgtcgcccaggctggagtgcagtggcatgatctcagctcactgcaacctccacctcccaggttccagtgattctcctgcctcagcctcccaagtagctaggactacaggtgcgtgccaccatgccctgctaattttttgtatttttttttttttttttttagtagagacggagtttcaccatgttagccaggatggtcttgatctcctgacctcatgatccacccgcctcagcctcccaaagtgttgggattacaggcgtgagccaccgcgcctggccctcccatacctttcttttataatttctttgcttttgagaaagaaacacatgacttattgtctcatatgtttaaaaattctatcactgcaaatgtgagttacttacataatgcttcatgagaaaatgaaataatacttcttagagctaaaagcagttaaagaatgattagaaaatctatttactctgtttcccatgttgaaatggtctttctgcattcgtgataagtctgtcaatttaatgcctgatagagttctgaaacatcttcagtgatgaatctttgtaatttctaggttcacaatagtctaaatatccatttgtctctgacaaagccaccaaatgtttattgtcatttaacaatcgttaatggagaatcaagagtttataatttggttaatcacaatagaaactagttggatgtggaactcaaggacttgtggctcagagtccttgtcattgggtcaggtgttgacaatttgataacagcacaaacaaaatatagtctctttcactgataagcaatagtaataaatatgatattttatttaaaataaaatattttgaaaaagtatcttagtattgtggtccatgaatgctgaatatggatgctgaaataatatttgtcacctttgtaaaaaaaaaaaaaaaaaaaggtagttttggccaggtgtggtggctcgcgcttgtaatcccagcactttgggaggctgaggtgggtggatcacctgaggtcaggagttcaagaccagcctggccaacatggtgaaaccccctctctcctaaaaatagctgggcgtggtggtgggtgcctgtaatcccagctacttgggaggctgaggcatgagaatcgcttgaacctgggagatggaggttgcagtaagctgagactgtgccattgcaccccagcctgggcaacaagaatgaaactctgtctcaaaaaaaaaaaaaatgattgtgtttgttgatcacttactatgaggcaaacattctaagtgtaatgaactcacttacagtggtttacaaactgatgcatggagagaataatttatccagactcacccagctgttaactggcagaattaggattttaacagagtcagtctggtaggaaagtctgctctttcccactatctggcagagataaatagtactgtaggagtccctgagaggtcaactcaagtgtaagtattttatattttgaggttcctaaagtttttctctatgtcattaacatacaagttgcccacattattctccttgtcattattactacaaccagtgagtattttgatagaatacttctgggagaggcccaggcgcggtggctcacgcttgtaatcccagcactttgggaggccgaggcgggcagatcttgaggtcaggagatggagaccaaccccgtctctactaaaaatacaaaaaactagccgggcctggtggcgggcggctgtagtctcagctattcggagaggctgaggcaggagaatggtgtgaatccgggaggcggagcttgcagtgagccgagatcgcgccactgcactccagcctgggcgtcagagcgagactccgtctcaaaaaaaaacaaaaaacaaacaaaaaaaaaccttccgggagagaagcggttactaagaagggaatgctttatagacagagaaaggatcatttttatggtcatagattattttctagtcttggccaaatttttttttttggggagggtgtattgtggtccaaagacaatttaggtgactcataacctatcacctctaatcccccaggtgtctcaagattgcatgctcatgagagtatctcagtgagtgaatagcagtgtctcctctcattaaaaatttatgcatatcataaatacttttaaaaatgagagtgtctcagtgaatgaataacagtatctccttgtatgaaagatttacacatatcatactttaaaaagtttgagtttaatataaattcaaaaatataaatcagctttcctgtaagtatattaaaaacctttttatgaatagcaattcaaaatattttaaaacatttattttgcacagcttttactagatttatcttattgctattttgttcaaaataaatggaaactcaagtttatagtcttgctctaaatcattttttaaaatatcagatttcagaaagtaacgtttttggcttattttagatatacctgcttgctggctgttgtgtgttggggtagagctttctttttaaaatctagtagcaccctctagagcaaaaggtaaaatacaatttgataagaaaggagcagtttcacaaattcaaatttcctatccggagtaatagtttgttacttagaagtaccaaagagctggccaggcatggtggctcatacctgtaatcccagcactttgggaggccgaggtgggcagatcacttgaggtcagaagttcaagaccatcctggccaacactgtgaaaccctgtctctactaaaaatacaaaaattagatgggcatggcatggtggctcatgcctgtaattccagctacttggttggggggtgggggggtggtgggggagaggtgggcggggctgagggcagagaatctattgaacccggaagacaggggttgcagtgagccgagatcacgccactgcagcactccagcctgggcgatagagtgagattccctctccaaaaaaaaaggaagtagcaaagagctgaacctaatttttttttgctcaaatatatatatattcttatcaaggatgccttttaggtaagttcttcttacctaagattaaagattaatacatctttttcttacctccttgtgaatgtaatggtacataattttattttagaatggatattttaataaaattacccataagtattgaatttcttgttgaccaatataacatgctaaagttttattgtatgtccattttgtatgtgatagtgtgtttgttttgagaattacaaaatagagaataaaccacaccccttgtacttacgctcttatttccacttgttttttgtagtagagcatgacacatattgggtcttgtagtagtcttgagtaaaaaattatctcgattaagttaattaataatattattattgatatatatccattttctattacagaagaaaatactcaggaaacatcccaggtgaagaaaagtttgactgaaaaagtttctctctatagaggtgacatcacattgctagaggtagatgctatagtcaatgccggtgagtagttgattttcctgtgatgtgtttgttatgtaagtattatttcaaaatttttaaataaataagaatgtaagtattttagaaaaaaatgctttttgacgtagaaatgtctattctgtttctcttcttgattaaaaacattggagatctatttttttgtatgttctgcaattaatgtgcatctacagtaccctctacagtgaaaggcgctaggttgagattaggatactgcaccactggagaagtgacagattgttgcagaaagttcttcagaaagaactttagcaagtatattattgttactttcgtagcttgaattaatagttggccaacataaatacaagctcatcaagcttttttcttcttttgaataggttgtcaggtgatgattgaactatgtaagacaaaagtgaaaatataaagaaattatttcagttatttcaaaacttaagttgttagggttccagttttcattttcattatgaaatgcttaattttaaccagcatattttaattatttttaataattagttgtctagttaattttcctatttcaacattgggaaaaattttacagatgttatattttattatgtggctatatatcaaaaaagatataacagccgtgattctacaaaaatattgtaaatgagaggatatttaatgattttaatttgtgttttgtaaagttaggctgtttgaagtttgcaagtgtcaattaaaaacaaatctggacttaggtaaggagaggctttatctaaatagactatgacaataaaaggaggaggatgatttcaatagggggaggcagaatattgtgttatcgggaatgtttttccagagttcagctggttctggggaagggctgttaaggaggggttactcaccttccattgcttcagggtggaccaaagttcaggggttttgaggaaggagaggagcctgactaaagtttggtcaggtcgtttgtgggcattgaccaaccagaatggtaaatggggacaaagagtttggctaacatgtatgagacagagaatgggaatttggaaagtctgtttctggccttgtcattggttgcaaggtggtcatctgtcagttttatctagtaaactttcccagaacacaaaagggtaggggtaatttcttgactgtggctctttccaagaatacagagttcaggtgagtttcagtgttatctccaggtttcctttggtgataataaattcacagagaatagtaggaaagtgcattggcaggtgaacagaagggtctaatggagaactgaaacattgttcaaggatattgtacagctctggcaatttagcagaaagttcagaataccggtcagcttgttgttcccttagaattgggtatcagttacagctgggtgcggtggctcatgcctgtaagcccagcactttgggaggtcgaattgggtagatcacttgaaggtaggaattcgagaccagcctggccaacatggtgaatctcatctctaccaaaaaaatacaaaaattagccaggtgtgatggcgagtgcctgtagtcccagctactcgggaggctgaggcaggagaatcgcttgaacctgggaggtggaggttgcagtgagcagagatcataccactgcactccagcctgggtgacagaattgagaccatgtctcaaaaaaaaaaaaaaggattggatgtcagttgctttgtaccacagctgctttgctgtaatcaaggctcagttttctccttttcttcttctgatgcttctgcacttcctttctcctttgctgcttctgctgcctgtctaaaatgtaaaagtcttcttgagagaggaggctgggtcatttaattgccacccaatatgactcactccttcatcctcaggttacctcatagggtacaggtctctcttatatgtagtatctatggattgctcatttgtggccctgggtatcaagatgctttctctgtcccgtggggcctctgggggaagacaggcccttagaaagggtctcaggaagtcctctcctgtagttttaataagatatcactatagctagtaatttaatgtatatgccctaaattctataaatatatgagctttaattttaaaacatttaaaagattatatgtgtgtatatatgcataaaagatatatgtgtgtgtatatatacataagagagatatatatacacatataatcttttatatatatacacacatataaataaaagatatatatacacacatgtgatcttttatatatacacacatatgtatatgtatacacatgatcttttaaatttttaaaaattaaagctctgctgggcgcattggctcatgcctgtaatcccagcactttgggaggccaaggctgatggatcatgaggtcaagagattgagaccatcttggccaacatggtgaaaccccgtctctaccaaaaattcaaaaattagccaggcgtggtggcgtgtgcctgtaagtcccagctactcgggaggctgaggcaggagaattgcttgaacccgggaggcagaggttgcagtgagtcgagatcgtgccactgcactccagcctggcgtcagagcgagactccatctaaaaaaaaaaaaaaaaaaaagttaaagctcatatgtttatagaatttagggcatatacatcaatatatatagacacataaaagatatatatttatactcacatatgatcttttaaatttttaaaaaatgtttatatgtatgtacatatgtatataaatacacttatcagccttcctgtgtgttcttgtaatttctagccattactcttagttctgtcctgaggaagtacaattgatcatatctacttcctttttaaatacttgaagatcactctcacaagttttctccttcttgttattaagataacattgaatttgccacgttagcacacacttaatacagtaataatggtctttgttggattttgctgtcttcccatggaagccacacactagtgccattttctctttttgtgtcaactccccaagcaatgtcatctccttcttaaaaatatttaatactgtgtatttgttaaattgaattatttaatatgtatgattgaatttgtagatctctgactaataggacattcagcattggaaacgacacagtgaaccagttggctctggtgttttttatctgatcaattaatacaaatattttgggagtaattattgaaataaatggtgcaaaacagaagaacatcattaactacctcatcactattttgttcttttaaatattattatcttgctcttgcctaaatgtataatttttcatagctgctgcataatatataagggtatgatgaatttatatgaagacaggcagcaacttttgcttactcccaaaacgatttggtaattttagctcacctctctggttgtgatgattgtaatttggccatgttttgcatctcacaaggatagtctcatcaggaagatcccaggtagatagaaaagggatgccaagtgaatatacactgtaatggctctatttacagctttctactgtgcagtttgtttgcctggtgtggaaggagtggaacagctgttaacttttcaggtgaacaagacaacatggcaggaaactatagagctgcctctactgagagggggagtgaaaaacagtacccctagtcactatgccaaagcagcccagttgtcacctcctattagacttctgaagttctcatgaccatattagtacattggaacacctggtcttagttgctatgaatgaaatgatttcatattttaaacttatttctaataaagtgttttttgaactaccttaacctctttaaatgtgacccagggtggacttcttgtgtattatattcttctctctaggaaattatgcatatttagtatgttttaataaaacagattttgcaggcattatagtacacagggcagtagcacaagtttagagttaggcagacctgggttcaaaattcaggttatcataaccaaggccattttttatttaaactttttattttgaaataatgatagaaaagacaaaaataacacagagtcctatgaaccctgtgtaaacttctcccaatggtggctttgtatatagctatagtacaatatcaaaagcagattttaaaaaataatttattttagtttcagggagtgcttgtatacttgttacatggtatattgcataatgctgaagtttggggtatgactgatcctgtcacctaggtaatgagcatagtactcaatggttactttttcaaccttgccctttcttttccttcccccttattagtgttgccatttttatgtccatgtttacccaatgtcaaaaaccgaaaattgatattgttacattactgttgtctagactacagactttattcagttttaacaatttttaaacttgcattcatgtgaatgtgtgtatatatgtgtgtagttctttgtagttgtatttaatgaatagattcatgtgaccaccaccacaatctagatacagaactattccattatcataaaagaactccctcatgctggccgggcacggtagctcacacctgtaatcccagtactttgggaggtcaaggcgggtggatcatgaggtcaggagttcgagaccagcctggccaagatggtgaaaccccgtctctactgaaaatacaaaaattagctgggcacggtggcaggtgcctgtaatcccagctactctggaggctgaggcaggagaatcgcttgaacccgggaggtggaggttgcaatgagccgagattgcaccattgcactctagcctaggcaacagagcaagactccgtgtcaaaaaaaaaaaaaagaaccccctcatgctgccacctttgtatttatatccacccatctgcctcccttcctgttttccatctctaaggttttatcatttttagaatggaatataattctaaaaatacataatcaataatgctgcagtgaacatggcagtaccgatatccctttgacatacttttcagtttctttggatacctagaagtagaatcaacagatcatatggcagttttatttttagcttgttgaggaacctccatggtgttttcctctgttaacttacgttcccaacagtgtgcgggagttctcttttctctgcatcctcaccaacacttgttagctttcaacatgacaaaagccattccaacaggtgtgaaatgatatctcattgtggtttccatttgtgcttccctaatgattagtggtgctgagcattttttttcatgtacttgttggtcatttgtgtgtcttcttctgagaaatgtctgttcagatcctttgcctgatttttaatggggttatttgttttcttgctgttgagttctttaagttctttatatattttggctattaattccttttcagatgtattttttgcaaatattttctcccattttgtgggttgtctcttcactttgttaattgtttgctgggcagaagttttttagtttgaggctgtcccatttgtctgtttttgctttcattgccacagaaattgaacttacagtagagagtatggttaccagaggctggagggggattggaggaaggaaatggggagttgttgatcaaaagtttcaaagttttagatatacaggaggaataggttttgagatttatctcatagcagggtgactgtaataaataataatgtattatatatttcaaaataactaaggaagtaaatcgcaaatgtctcaccataaagaatgatagataagtgaggtgatggatgtgttaattagcttggtttaatcatccacactgtgtatatatatatcaaaacatcacattgtacctcataaacgtatacaatgattggtcaatcaaaataataataataataaagtcatgtaaatagaatcatacagcatgtaatcttttaaggttgccttttttcactaaatataatgctctgagggccattcagattgtattaatgaattaatgaatttatttattaattcagtaattgttcattcctttttattgttgagtagtggttcattgtatggatgtaccagagtttgttcaaccattcacccattgagggacatttggattcttttcagtattttgctgttaccgataaagcttttatgaacatttatgtacatgtttttatatgaccatacatttttgtttctctgggatagacatccaagaatgtgattactaggttacatgtaagtgcatgtttagttttgtaagaaactgctaaactgtttttcatagtagttgtaccattttacattcttaccagcaatgtgtgataggttcagtttttctacatccttgccagcatttggtggtataattatttcttatttattttagctgttgtaataggtgtgtgttaatagctaatcatgttttttgatatttattttttatttttaaatttttttctctgctgtttgaatcagcatcatcattattttaatttgtgtttccccaaaggttaattatgtcaaacacctctccatatgcttatttgccacctgtatgtctttttggtgaaatatcagttcatatcttttgccattttgtaatgggtctcagtgatatttgtgaattttgggcatttttattttttaaggccccaccctaaatcatattgatatatactgaaatatactacagcccacatccaaaacagtccatacttagttggatgatagttaattagttaatataatggcatgttttgtagatatttaggtaaacattaattttgattttgtacttttcatattttggaaacctaaattatctttttctaggctcttgaaaagctttttggtattatgctcatagtactaattataaactgccctgctgacatcagcttgattgggcaaattattcaaccctttaatcctcacttttgaaatctataaatagggataatactagtaattaagatcagacagatgttgtaaataatgtgtgaaaaatacgtagcacagttctcgcacaaaatatgtacttggtatagtttagctatggtatttatttttgtatggctactgaatggatttaatactactgctgtcttttctgagagaactcaggttagtagaggaaacggaggatatcttctgtgttaagcattgagattttccattattcagagccagttttccgctgaaaagcactggtgctcaagctagagcagctgctttcttcctgagcagttttcaaaattccacatatttttatatggatttgtctagttactaatatataattgacacttacctgtatgtacttttagtttgactctattttaccttattttttaaagacaggaatctcactctgtcactcaggctggaatacagtggcataatcatagctcaatgcaggcttgagctcctgagctcaggccatcttcctgcctcagcctcccaagtgctaggactacaagcacgtgccaccatgcctggctaattaaactttttttttttttctgtagagacagcatcctgctatgtttcctagggtggtcttgaactcctagcttcaagcgatcctactacctagacctctcaaagtactgggattataggtgtgagccaccttgcctggcctttgttttgattctggttttaaataaagtacaactgtctgtacaaaaaagaggtgttttcagaactagattgtctatacgtgatgttcagattctgcctcacaaagcagtatttttgtagaaaaaaattcagtatttactatgagtaaaagtcacactttaaaatcagttacctcatggggatgcttgaaaatattttggtacatatgcttagctctttacggttaaacaaacagattttcaaatgctgcctaaatagaggagtaagaaacactcatttgacaaaaaaaaaaaaccccaaaaataaacaaaaaaaccccaggaaaatgtattgagtgcttattatcagttaagaactaggttgaacagtggaggtaaagacaagtaagtaaacagttgctgtacagcaggatgaagtgtttattagagccacgtccaaggtgccatgggcaaatagagaaaagcaaacaactcaagaaagcaggtgagtgtatattgcacttaggaaaccacatgtggctgagtgtgcttggagcaaatacaggcagaggccagatcatgaagtgctttgtatgtcactttgagggctgaggtttttttttttaaaattttttttttattttttagaagatggggagtttttgaaaacatttttagggaggatatgtgttagagagatccctttggctgcagtgtgaaggataaattggggaaggattaagtttaagggggagactggaagcagaaatgaaactatttaactttgtactaagtacttcagcttaaataagtctgatttttcccctcctagctcataattgtagctgttgcttcttctgactctgccctctttaatggtgggatgattcttggatgattatgatttgaatgcagtttgatttggagtaacctcgaaaagcttaagtctattgtgactggattagagcagacaaatagaatcaaagtgtatttgttctttcaacaactttcttgaattctcaatttgtacatatgacatatcaagacactgctaatctggcttctgctaaactgttttcattaaaactgttctcaccaacgtcaccataacctctttttcttgaagtaatgggcccttttttgatccttgttttcctggatctctctgtagtatacaatactgttgactacttcatccttgaatgttaattttcctttagcttcagtgacacatttggtagtctcctctccttagctatacagccataaccttcatttaaatcacattatttcttacctagactattgcagtacactcctgaatgctttacttgcaaactcacctactctccagatgcagacaaaattatctttctcacattacttctctgtacagccacctttagttgctccccatggcccataagattaagggcaaacttagtgtgtcaaacaagacttgcttcaatatccctgccttgccagtctccagtccaccagtctcttgccactgacctgcaattttttctgtcccccaccgtttttctcatttctccctcccacccactttctctttcccccttttcctcctgggctttgcacaagctgctgcctctacctaaaatattacttctctaaagagtttcccttcctagcagttcctgcctcagtctttcagcatgccagatgtttcatctcctactggaagcgtggattcccctccatccttccaatcttgaatgagtgtcagtactatgggttccttagctttatacacttctgctagcatagcacataatctaatatcagttcacttatgaaggccaccgaaatgatttggatacatttgcttataaaggctttataagatttttaccaaaatgaaatcacaaaattaaaaaaaaattgtgggaaacttgaagatccccaagatcttcagatgccagtgtgagaaacacagccatagaggataggaaatgtaggactcaagtgagagactggaattaaagacatagattaagttagcatattaattttataaatatgattggtaagaggtattgagagctaaatgtgctaaattgttatgataacctaagaggcatatttaacagatgaagaaacatagccacggagaggttaagtgattcacctctggttatacagccagtaagtagatctagagcttgtgttcctagcatctttcctgttgaattctttcacacagaagctatgataccatcctaagccatctatctatattaaatatagataattccttagttgaccttttggctcttggaacactatcaaccaatatgtgatatcaggagtttttattaaaagcatgtagtaattatcatctctattaaataatacctcatgttttagtccttctctgggaatttaacaaccacatcttgtttgaattgactataggtcagttagtgaagtgctgacagtctgagcaggtctggaaacatggcctactgaagtgtagttgacctgcctttgacagttcattgtaactttggaaggattatatccaaatattttaaatgcaaaagaaaaatgttaccttgctcactgtgcaggaatagtaaacaataagatcattcctcttcttttcaaattttttggaagtgtttaatttactagtatgtaggacagaacgtatttacaatcaggtctagataggtataaataaaaggatgaattaaggttaaaaatgtctgtgggtcctagtaaattatattggcacacttttggactgagagtggattattttttctccacgtacagatggattctccatgtacagaagagatagacctggaagcaaatagatacagttcattgtgtataaagtatgtatcgagtactctttgttgatgcaaagagagttagtaaattatttgttttgatctaattcctgtgatgaataaattgtaattttgagtcagaattaattttcaggacctagatataagttattttaccttttttttttttttttttttgagacagagtcttgctctgtcacccaggttggagtgcagtggcacaatctccgctcaccacaatatcctcctccccagttcgagggattctcatgcctcagcttactgagtagctgggattacaggcaggcagcaccacacctggctaacttttttgtatttttagtagaaatggggttttgccatgttggccaaactggtctcaaactcctggcctaaagtgatctgcccatccggcctccaaaaaggattgcaggtgtgagctactgcacctggctagttttaaaaacagtctttgcatatatgccatatggtcagggattttattagttccttaccttgtttgagccatagagctaagaacatacttggtcccttatcttaacattgcatgtcctaaattgtgttttgagagaggataacagatgcatctactaatctttggcctcctgtctttctcccttcttgacatttacacacaaactttgcccatgggaagtttagtgcctttcctagatttctgaggatttgttttgaggatgcttacattttcatgattgcttctttctctgtaatatggttctagtaaatttccgatggccacagtttcctccttatttcttgccattgctgttttctctgtcttccctgcaggcttcatcccacacttagaacaacccaatatttcctctatttcccaaagcactactaatattatgggtagtaggtgtgtactgtaatttaagggttcatcaaacaggcctgccatcttaatgtagctgcatataggattatctgtttacagtgactaggtccttgtatagtcttataccaaacccattggtcaaagagctttggtcttttctagagcttggggataaatacatccatctgatttatggttcagtatgtcattagagacaattttacttgtactgtgccacaatcacagaaaaatattttggagaagatagattgcaggctgtgttatgaaaaacgaatgataactgtctaattgtaattggttggttatagccaaaaattaattcagtttgtcagaaaagtgatttttaaaaatggaaagtgaagaaagttgatttatttattttagctcttcctaccccatactacaaggagaggcatatttacattgtgattaattatagaggacttggagtcagatcaatcattattttaaatatgcctattcaacttcctggccaaataactctgacaaattatttaacctttctgaacctcagttttctcatcagcaaaatggagataatacaggttgaatatttcttatccaaagggctagaagtgtttcagattttttttgggttttggaatatttacatatacataatgagaaatcttggggatgggacccaagtctaaacatgaaattcatttatgttcatatacaccttatacacatagcctgaaggtatttttatacaatattttagaatacttttgtgcaataaacaaagtctgtgtatgttaaactgtcaggaagcaaagatgtcaagtgttgaattttccactcgtggtgtcatattggcacttaaaagcttttggattttagagcatttcggatattggatttttggactagggatgttcaacctgtcgtagagcctatttcacaggtctgttgtgaaaatctaaagaaatgatggccgtctaaagagatacaaagtacttcacacagtgccttatatacagacacatcagtaaatggtagcagaattatactccttagttttaatatttgaaaaaatttttatatgaatgttacaaggtaattatgggtgtttttcaagtcctgtacaaagatatgtgtaagaccaactaacagggtttattctgtgtccttcagctttagctgtgacagtatttacttgaattgcatttaggacaagttgtccaattctgaagttttataataaaagccaagtttttatgacattcttgtaatttgtatgaaccattgaccaaggaaaagaatggttttagtgtacgttaacaatgtgtttttactacattagttgtgaatgtcatacttgtgtcaaaaattgagatgatgtcataagattgtatagataaccatttaatagctgagcatgatttaagaataattgatgtagaatatatgaatttttatataggtaaataacatattaggactgcacaggatgaaaggaattgtacttattagaaatgttttattcacctctacttgcttaaaataaatgttatttttatgtatttgttcagtaaaactgaaatgaaataaggcatatttgaagttagaatttaagttattggggaaataaggttaatttactctcttaaatattttaggacacaattaacagtaactacttgattcagtttgaaatttcatctctactagcaaagcatcaaaagtcatcaaagtcaaaagtcattttgacttttcacaaagtttttgtattatatattttttctcttgactttctgttgagcagtaatagatccaaacacacacacagaaatatatagcttaataaattttgaaaaactgtcacacctgtgtaatagaatccagataaaaaagcagaacgtggctgggtgtggtggctcacgcctgtaatcccaacactttgggaggccgaggcaggtggttcacgaggtcaggagttcaagaccagcctaaccaacatggtgaaactccatctctactaaaaatacaaaaattagccgggcgtggtggcatgcgcctgtaatcccagctactcaggaggctgaggcaggagaatctcttgaacccaggaggcggaggttgcagtgagccaagatcatgccactgcactccagcctgggtgacagagtgacactccatttcaaaaaaaaaaaaggcagcagaatgttaccagtaccccagaagccctcttggcatccctggtaatgaatatagtgaagtgtatttactatcttgacttctagtaacgtggattacttttgcctgtttttgtatttcaggtaaattgacctatatatattctttagtgtttggctgtttttgttcactattatgcttgcaacattgatacataccattggttatagatgtagatgattcattatcattgttatgtaatatttcattgtataaatatgtcacaacttatatatcctatctactgttgatgagcggccttaagtagtttctagtctgggtgttttagtactgcaatgaacatggtaacacatttgtgtgtggtatttttgtaaatagatatctatatatttgtgttggatctatatctgggatattaactgtaaaatcataggatatatgcataggacactgttgtgtggttttcactttatacttccaatagcagtgtatgagagttcttattgctctagatccttgtcaacatttattttctatgtttttaaaaatagtgcataaattaggtcaactggtaatattttcattaatttgtaagatataccatgataaatcaaatttgatagcagtttgtagctaacaatccatgttaagccagcatttgtaagtgaagaaataaaaaatgtaaatgttatggtcatatggccaaggataagaagatggggttgttttatgtagttcctattgagttcatgaaaatacaaatgtatttttctcccatagatggcaacacttaggaacaaataaaccattgtattatgaaggtaatactattattattactactatcactgttaacccttcatcatatgggaagacaaagggaaaaaagtttttggaatgatattctcaaaactacatttggaaaaaaaggtaattttagaaaaatgtctcagaaagtctatttccatatgtgaaatattccataaagcctgtcattttgttgaacatagatattttaaaatcctgcagtataatcttaaagtcacattcaaaataggttgatattaatagtttgcttttgcatcgtagatatgccttattaataaataagattcgtctaatttcttatagtattaataatttaaagatatatcacattaatttttttccaactataacactgatgcatgtttattgagagaaaatatagaatagtataaagaagtaaaatgtgtcaaattttactatccagaaataaccactattaatacttgttttacatccctataggggattttagagactttaaatattatatatagtatatataaaaatatatattttttttattttaaatatatataaatatatatttaaatgtatttatatatttattttaaatatataaatatatagtatatatacatttatatataatatatataaatataatatataatatataaaaatataatctataatatatattacatattatatattatatatgatatataatcatatatcatatataacatatataatataatataatatatatcatatataatatataaatagtatatttatttttgattaatataatcaaaattgacttgacttaagttagttcaagagttttgacatctttaccgtattgtcctcccatctcggactgtggctggttgttagatttattttatcttttccccctgatatttgtcagtacaatttttttattatttattttatctgattattttggtgatataatcaatttgataattgtccaccttactgaagttaattataaaaacttttgagttggttcccttggattttctaggcatatacatttttatgcacactgcttctctgccctttttattccattggctaccacatggcaacaatattaaattagttatcataaggcattcttgattattcccgattttattgggaatgaccatagtattttgcaattcattcaataaatatttattaagtacctactatatgacaggcattattttaaatatgagagataaaatgatgagaaaaacagttataatctaagcccctgagtttacaacctagtgggaaattgtggtcaaagagttatcttaataaatataaaattataattatgtaagtttagcgttgatagattggggcttttgttgtaaatttccttttaaatttggctaattataaggaagcctaagtttccaactataaagcatttaggtccttattagagagagtttgcctgttaggaaagttgaaatgaagttaaagtattaatcacaatgaaatggttattttgtgtttataagcaaagacaaaataaaacctaaacagaaaaacccacctcatctatttttgacccctgtatctctgcttttaagggtctattccctggagttaaatattatagtaacatagtcttccaggagctttgttttggtctttaagagagactaaaagaaaaaaaaaacgtgagacaacagctgcttcggcatttattccatgttattttgagtttttaagcaaatagacaaaataaaacatcaatttctctgcatgatttctttaaaccttttgtgtttttttcttcttgttgactgagcacttaagttcatactttttcatattgctcttttttctttaaaataatttggatgtcttttaatgagtcttttttttttttttttttttttttttttaagacggagtctcactctgtcactcaggctggagtgcagtggcatgatctcggctcactgcaacctccgcctcccaggttcaagtgattctcctgcctcagcctcctgagtagctgggactacaggtttgtgccaccatgcccggctaatttttgtatttctagtagagacggggtttcaccatgataaccaggatggtctcaatctcctgaccttgtgatctgcccgcctcagcctccgaaagtgctgggattacaggcttgagcgaccgcggctggccttaatgagtactttcattgcttctgaagaactcagagggactcaagagcctgttgagaaattcattattaaaactgttaattataaagttactgaaatttcagacttcttaatttgggataaccatctaaataaacaattaacagctggctacaaactacttatagaatgatactgttaaagtttgggggagcaatagttcttagcatagaaacaataatgttcagaaaccacctcctgcctctctgcagatccaacccaatttccattcaaactaagtcagccaaaggggaaaaaatgactgcacaccattcacttcttttgttttccctcctctgctatgccagaaattgctggaaattgtccaaatcaccactgttgatagctgtcatttagtcaatctgtgggatatgtttgagtaggtgatggatgggaatatatgatataggatggggattgggatataggatatatggggatatatggggatataggatggggatgggaatatttggggatataggatgtaggatggggaagaacttttttttttgaagtggactctacactggttatagcttcatgtttgagcttctagctattaggatctcagtgtctttttaaaaatagtgtggggatagacagaaaacagcatttctatgaggatggagtgaaagaacaaatgaacatgagcttttgtaatgtgttaaattatcattttttgttgttatttagccctgcatctcagcgtctttttcttcaatctgacttatcactttgtttttctgatctatattttttttttctgaaggaatttgtgcagtcaaactaaacattaaatccttcaaggaattagaagataattctcaagagaaaataattgccagggagatggatggttgccaacaaattcccttctgagtttatttttttgttttcctactttgagccctgctatccctatttttaaaggaatatcttctgaagttaaatagtaacaaagtcttccagagtctttcttttagtctttgagagagactaaaaaatgcaagggaaactggcagccactgcttgggcatttgttccatgtttttagagatcgtcttctctctttgagaattcttcagtgcacttagggaaacttatattttgtttgttatacatactggtcaactgggttttttaaaaaagagaacagtttttttttccagtctgattataaaaggaatacacatgaatacttaagataggaagaatgtaaactagaataacagaacttcatctctaatgtttgtaagtatatatatcattgtttgttaaagttcagtgtttatgcttctggttattttattttcattgcatagatgtattttgtttttttacaaaactggtgcaatagtacattttaaaatttgaggactgcttacttttttgtttataaatacaatactttttatatgtaattttaaatagctacatgatattcaatcatatacatgaattttaatttatttaatcatcccctcattgttggaaatttaaattattttaagttttttactgttataagcaggctgcgacaaacatcctagcacataaatgtttgtagaaatctttgattattcccttggaggacattcccttaaagtgaaattatggaagcatgaaagttttaaaacttttttaggtacacacagacacacatacacatacatgtatatcttatatctacatacacacacacgcacatacacacacataaccaaatagctctatggaaaggttaaattaatttatatctcaaggtgtaagagtatatatttccctaaactttaccattattaggtttgatgaatttttttatgctttgtctttgaattatacttcaatgttgttttaatttccatttctttgaagacagggagtataccttttggtattaccttctgtaatagaaagcaggatcttacctataaaattttattggcaccaatagggtacaaagtaacttggtggtgggtagccaagaggcattggtgttggggtgggacttgaggagcaacacacgctgaatgtttttcagctaagaaactcagatagccgaagttcaatgtcactgcttctcctcctgaaatttaagatggtggggaatacagatgattgctgaagttcctcagagtgagagaggaactgtttattcaactttcagcatagtacctaccatgtagcacagcacttggcactggggatgtctatggctatggctttggttcttggagttcactcaggacagtttttctgaaactttgaggttttaccttaggcaagaagctctcaagtttctcccccagggctaagatgagagtggggatccattggtgacgtataagccagagcacttctccctttgcatccccagcttcagaagatggactaagccctcacatgctgcttttcatttggactgagccaattaaactgagactgtagaagagggaaccagtttctgggaaagtaaacagcagcgtttatattagtatgagggtcatagggaagtggattcttattctacctgtggttaacaatgaatataaataccctctgctgtagttcagttcttgtaattgcgtggcttgtcagaggtcaattatagtttaaatataagctgaactgtataactatactaactgataattcatgaggcctaggggctggctaatcctcatgtgcaaccttatttggaatattccatgcacttttactttttaaaatttttatttaaataatgagtaaggaggaaggctgaatagaagcccacaccatttgtctctcctgtaggaatacaaaattttaacaactacacaaaaaagcaccatcacaagaaccaaaaatgagatgaggaatcatagtacctgattgtaacttcatattgctgaaagatgcactgacgagggtaggaaagatgttcttgaatcaccaatgccacctcagccccattcctcggcattggctatgtggtacagagaatctgaatttggaggaaggagagcacagtgcctgggtgactcagtaaactcagcgctgccttgtcacagtggtgatcacagctatgctgggctcagccagtacctgtgcatggaaggagcatttggaccagacctagccagaggcgaattgcccatcccagtgttcagaatttgagcttcttagtagacctccccactgagggccagagtgctctggggtcctaggtaaactcaagaggcagtctagctcacaacgactgcagttcctatgcaactcctagtgctagtctgggcttggagccagtgaactagggtggcatatggcctagagagacaccaaatggggcagctaagggagtgcaccatccctcttccaaccccagacagtgcagtttgcagcaacaaaagtgactccttctttctacttgaggagaggagagcaaggagtgaagaggactttgccttgcatcttggataccagctcagccacagtaggatagggcaatgggcagagttgtgaggccccctttctggccctaacaggccaaaagagaacctgcggccttgaaggaaaggacccagtcctggcaggattcatcacctgttgactaaagagaacttgggccctgaataaccaacagtgataccagatagcataccatggaccttgggctctgagatgtgctggctttaggtgttacccagaacatttccagctgtggtggctatggtgaaagactccttctgtttgagaaaaacagaggggccacagtggggtagagtaacaagcaggttcttggacagcatttatggaactgccctgtgcctgtggggagcccactgccctgaagggtgagtcctaggcctggtagcattcaccacaagctgactgaagaccccttgggttttaagtgaacattggtggtagcctgacagaaccccacatgggctggtggtggtagtggccacagggagagtctcctctgcctttggaaaggggaaggaagagaaggaaggactttatcttgtggtttgagtgccagcttaaccgtggtaggcattggtgttggggtgggacctgaggagcaacacatcacgtaaatctctaaggtttttgactacagtccttggatctcagagagcattcctgaactcacctagggcctgggggatctcattgccctgaagggagggacaaaaatctggctggctttgccacctgctgattgtagagtactagggccttgaatgaacataggtggtagccaggtagtggttacagtgggccttgggcaggacctggtgttgtgctggcttcaggtctgaaccagcattgtcccagtggtggtggtcacaaggatatgtgtgtccctataccctcagttccaggtggctcagcatagagaaagagattcagtttgtttgggggaaagtaaggggaaaataataagagtctctgcctagtaatccagacaattcttccagatcttgtccaagaccaccaaggtggtacctttatgagtctgcaagaaccacagtgtttttgggcttggggcctaagtccctttgaatacctggaaagtctttccaacatggaggggcacaaacaagcccagactgtgaagactacaataaatacctaattctttagtgcccagacaccagtaaacatctacaagcatcaagagcatccaggaaaaaatgacctcacccaatgaacttaaataaggtagtagggaccaatcctggagaaacagagatatgtgacctttcagacagacaaatcaaaatagctgtgttgaggaaactcaaattcaagttaacacagagaaggaattcaaaattctatcagagaaatttaacaaagagattgaaattattaagaatgcagtagaaattctagagttgaaaaatgcaagcaacatattgaagaattcatcagagtctcttcttaatagcagaattgatccagcagaagaaagaattaatgagctcaaagacaggctattaaaatacacagtcagaagaaacaaaagaaaaaagtatagaaaagaatgaagcatgcctacacgatctagaaaatagcctcaaaagggcaaatctaagagtattggccatgaagaggagatagagaaagagatggggtagaaagtgtattcaaaggaacaatatcagagaattccccaaacctagagaaagatatcaatatttcagtacaacaaggcagatataacaaaaaagactacctcaaggcatttaataaccaaactccccaaagtcaaagatagggaaaggatcctaaaagcagaaagagaaaagaaacatataacataaaatggcacttcagtacatctggcagcacctctttcagtggaaaccctgcatgccaggagagaatggtatgacatatttcaaatctgatggaaaaaacccctttgccctagaatattatgtctggaaaaaatatccttcaagcatgaaggagaaagaaagaccttcccagagaaagagggattttatcaacaccagaattgacctacaagaaatcctaaagggagttcttcagtctgaaataaaagaacattaataacaataataaattatctgaaggtacaaaattcactggtaatagcgcacagaaaaacagaatattataacactgtaattgtggtgtataaactactcaagtacaaagactaaattaaccaatcaaaaataagtacaacagcttttcaagatatagacagtacaataagacacaaagaggaacaacaaaaagttaaaaagtgggggatgaagttaaggtacatggtagttattagtttttttttcttgtttatgcaatcagtgttgtcatcagtttaaaatattgggttataagataatgtttgcacgcctcacggtaacttcaaattgaaaaacatacaatggatacacaaaaaataaaaagcaagaaattaaatcatgctatcagataaaatcactttcactaagaggaagacaggaagggaagaaagaaggaagagatcacaaagcaaccagaaaacaaataacaaaatggcaggagtaaatccttacctatcaataataacattgaatgtaaatggacttaagtctccaatcaaaagacataaagtggctaagtggataaaaaaaaaaaaaaagctagacccaatgtctgttgcctacaagaagcacatttcacctatcaagacacacatagactaaaaataaagggagggaaaagatattccatgtcaatggaaagcaaaaaagagtaggagtagctatacttgtatcagacaaaatagatttcaagacaaaagctgtaagataaagaaggtcattatataatgataaaggggccaattcagcaagaggagataagaattttaaacatatatgcacccaatgctggagcacccagatgtatacagcaaatactattattagagctaaagagagagatataacccaatacaataataactggagacttcaacaccccactttcagcattggacagatctttgagatggaaaatcaacaaagaaacactggacttaacccgcactatagaccaaatggacctattagatatgtacacatcattttgttcaacgtctgcagaatacacagtcttttcctcagcacgtggatcattcttaaggatagatcatgtgttaggtcacaaaacaagtcttaaaacattcaaagaagttgaaataatatcaagcatcttctctgaacacaatggaataaaactagaaatcaacaacaagaagaattttggaaactatacaaacacatggaaattaaacaatatgctcctgaatgaccagtgggtcagtgaagaaattaagaatgaaattgaaacatttctcaaaacacatggtaacggagacaaaatgtaccaaaacctatggggtataaagaaagggaaatttatagctaaaagttcctacattaataaagaagaaaaacttcaaataaataacctattgatgcatgttaaagaagtagaaaaccaagagcaaataaaacccaaaattaatagaagaaagaaataataaagatcagagcagaaacaaatcaaattgatatgaagaaaacaatacaaaagatcaatcaaataaaaagtttggtttttgaaaagataaataaaatgaacccatatttagccagactaagaaagatagaagacccaaataaataaaatcagagatgaaaaaggagacattacaacgaatactgcaaaaactcaaaggatcactagtagctactatgagcaatagcatactaataaattggaaaatatagttggaaatggatatattcatagacacatacaacctatgaaaattgaaccatgaagaaacccagaacctgaacagatcaataacacattatgagatcaaggccacaataaaaagtctctcagtaaagaaaagcctgggacccagtggtttcattgttgaattctactaaacatttaaaaaagaatgaataccaatcctactcaaactcttctgaaagtcattctgtaaggcaagtattaccctgataccaaaatgaaagacacataaaaaaaacaccaaaaacacaagtacaggccaatatctctgatgaatattgatacaaaaatccttactaaagtacaagcaaactgaattcaacagtacattaaaaaaaccatttatcatgaccaagtgggatttatcccagggatgcaaggatggttcaacacatgcaaatcaatcagtgtgatgcattatatctatggaatgaaagacaaaaaccgtatgatcatttaaattgatgctgaaacagcatttgataaaattcaatattccttcacgtttgtaaaagatctaaaaaaactcggtatagaaggaacgtatctcaacataataaaagccatgtatgacagagccacagctggtatcaccctaaatgggggaaaactgaaagcttttttttaaagatctggaacatgacaaaaatgcctactttcaaccactgttattcaacattgcattgggaattctagctagagcaatcagacaagagaaacaaataaagggcttccaaattggaaagaaagaagttaaattatctttcttttcagatggtatgatcttatatttggaaaaatctaaaagcttcaccaaaaaacaaatagaactaataaacaaattcagtaaagttgcaggatacaaaatcagcatagaaaaatcagtagcatttttatatgccaacagtgaacaatctgaaaaagaaataaaaaggtaatcccatttacaatagctacaaataaaattaaatacctaggaattaaagaagtaaactatctctacaatgaaaactataaaacattgatgccagaaattgaagataacacacacacaaaatggaaagatattccacattcatggattggaagaatcaataatgttaaaatattcaactacccaaagcaatctatagattcagtgcagtccctatcaaaataccaatggcattcttctttacagaaatagaaaaatcaatcctaaaatgtatatggaaccacaaaagacccacaatagccaaagctatcctgaacaacaggagcaaaaactggaagaatcactttacctgacttaaattatactgcagagctatagtaaccaaaacagcatggtgctggcataaaaacagacacatagactaatggaacagagagtctggaaacaaatccatacacctacagtgaactaattttcaacaaaggtgccaagaacatacattggggaaaagacaatctcttcaaaaattgatgctgggaaaaactggatatccatatgcagaagaatgaaactaaacctatatctcatcatatacaaaagtcaaaccaaaatggattaaagacttaaatctgactatgaaactactacaagaaaacattggggaaactctccaggatattggtctgggcaaaattttcctgagtaatacttcacaagcataggcaaccaaagcaaacatggacaaatgggatcacatcaagttaaaaagcttctgcacagtaaatgaaacaacaaagtgaagagacagcccacagaatgggtgaagatatttgcaaactacccatctgacaaggaattaataaccagaatatgtaaggagctcaaacaactttataggaaaaaaatataataatcccattaaaaatgggccaaagatgtgaatagacatttctcaaaagaggacacacaaatgtcaaacaggcatatgaaaaggtgttcagcatcactgatcatcagagaaatacacatcaaaacttcaataagatatcatctcaccccagttaaaatggcttatatccaaaagacaggcagtaacaaatgctggagaggatatggagaaaagggaacctttgtacactgttgatgggaatgtaagctagtacaatcactgtggagaacagtttggttcctcaaaaacctaaaaatagagctaccatcatccagcaatcccactgttgggtatataactgaaagaaaggaaattggtatattgaagagatatctgcacacgcatgtttgttgcagcactgttcacaatagctaagatttggaagcagcctaagtgcccatcaggagatgaatggataaagaaaatatggtaggtacatatatacacaatggagtactgttcagccataaaaaagaatgagatccagtcatttgtaacaacatggatggaactggaaatcgttatattaaatgaaataagtcagggacagaaagacaaacttcacatattctcacttgtgggagctcaaaaaatcaaaacaattgaattcatggagatagagagtagaaggatggctactagaggctgggaagggtagtggggggttggagggtaagtggggatggttaatgggcacaaaaaatagttcaaaagaatgaacaagggctagttttgatagcacaacagagtgactatagtcaatagtaatttagtggcacattttaaaataactaagagtataatttgattttttgtaacacaaaggataaatgcttgaggggatggataccccattttccatgatgtgattattacacattgcattcctgcattaacatatttcatgtactccataaatgtatatacctactatgtacccacaaaattaaaaaataaaattgaaacatttttgatgtatagttttattaattttagttgaaagaaatgtatgctttatttgttacatatacaggtcaacttaatttctaaatattattttttacttttttatttgtgacttttaagcagctgctacctttgtagattctaaaaaatctggatggtattcattttctcctattgtcttaatataattgcacacatttggccattttttgacttaatttttctggaaaaatgacatttattattgaattccagtctttaatttacataaaaattaggcaccagaaagagtagtggagtaaaatagcttatcagtagataatagacatcctcatattttcatgaaatataaatctatacaactttaggagtttcagaggaacttaccgatttattaactttgcgttgggtgaatagctcttttatgatgtgaattctgtatctttaaaaaggatacttgattaagaacagtattcttatttgtagcccaaatttgtgccttttgaataataatggtttattaaacttggtgttgtgtaaaggaagatttggccattttgataaggaaaggttgagaattatttttcaacattcttctctagtttacctttttagttatagaagcaccccatgtttggtttacaataagaatagaaataaatattttatttttacatactgttagtacaaaggcagcagctttttcactactcattttatttttgtaaatttgaagcaaatttatggcatgaaatttccccagcttcttttgaccttgaggtgcaatatgatttgctttgtgaagttttaattttatgacacatcacatttctgtcatgtccaaaattaaacttcagggtaggtgtatatttttctacactgggattatgaacagaataaattatcagagaattatgtttaaatgaatatataagtataggaatgtataggcttagctacatctctctacataaatagcttgttagtgtgcaatcagtcactggagttgccatgaacttggagcttaatgaacaggtggagaaagaggatgaattccagttcaaaatggatctgacagcttatcaggcaatttcactgatcgctaatccagttcgtttggcaacttaatttatcacacagttagaattctcatcccgtgggtttccaggtggaaattaattctggaacatgtccattaccactgggttgaagagacctgcttaagctttgtgaggaaatttagaaataaattattttaaatgcataagccagatttctcttatgattccctttgtgtttatccaattccttcttaaaatatttggatgctgctagcatttgatggtatgcccatggaggtgaactaaggtttatttattcattaatatttataaattaaatggaagaaattgttaatcctaattaattagtgaaataactactataatagataatcctgtgaatataattctatctttaggtatagaaaaattgctgatctcgaacatgttttaagcatttcatagcaacaaataatgaacagaagaaattatttccttaaagctcacaaatctatgtcttctgagtacttacaaattctctaattagtctgatttacagcccattattttatgtaaaagtatctgctaaagcaatttccttgacaataaggaagaaatgcgacttgcctctcacagctcacattctgactctgtttggaattcccaaggatgagtctaattaaatgggcttggcttaggacctggctgtagcttaaaataccttcaaaaccagaaacacattttctccactttttaaagacttgatttatagtgcatagaaagttaaattgaatattgatccttgaaaagcaaatgtgtcctgtaaaaaatgacaacaaaagaatacaataaaagatgacagagtgattgattgtccaaagcctatagatagtagcctcccccttttatgtcatcttctctaggcatctgtagctctgagagggtgatagggatgaagtgttagaggaggattagttgcaccctgacatgaactgttacattttataagaagattgaggaaggtggtaacaaattatttctaagaaggaattttgagaaacgaggaacggggcacaagatcagtaagacctatgatataactccaggaagggacacgacggaatttcttataatttctcaaactctgaagcatcttcaaaaagaatttaagtcagtgaaaaataattgagatgatagaaaactacaaactggcgtaacagtgtcattgattggatatgtcaggaaaattgtgcctatcattcttatgaccaggcttattaaagtaatatcttcataatctagaggggctcagtgttggatcatcctggcatccttctcaaatcccttttctgagtccttggcatttttccctggagcatattgcagacctacaaccttgtcatttcagaaactgtcctttcatttttacctttgaagggaaatggttactgagtccagtactagcccttgggaatcaagccaaaagaaaaaaatggtagggcattgtttgattttctcctcctttcctacaagagcagtggttgcgtcaaaggttcagtgggtattggaatcaccaagaaggagataatgatgatgataaagcacagtggatcaattcggggttttcctcctttttttaaaatgtttttcctattaccatcactgtcactgtgatgatgataatggtaataggaaaaatatataaaacaaaatggggaaaaccgtaaatagacccagtgtgctttataacatttctgatttactatttattactcctcattatttaataaagtgtcccatgtactatgcaaatggcagacagtaaaacccccaccatgctgtttagtgaaatgtgaggatcatgtataaaaaatcctcaagctagacttaggttggatgaagaagacagtgagaaatcttgtctttttaggttaggctttcttgtttttcctttgtttaacttttgtttcttcaaatggcttgcagcttggaagagacaacttttggtctaaaaactattttggttgcggacagaggcagtatcattgaaaaaacagtgtgttcaccaattagaagttcatattgcttttaattctgcttccaacagttttgggacttgaagagtgaaattgagatttgtgtattttttcttcagtgctgcataaatggccatttatggtaaaacctgagaataaaggaagaccaaaaaaagcaaaataaaataagacagaaatacacaaattatagtgattctgatttttccttatgaaacttgagatccagtaagtaaacttcggttggaattattgggcattcaaacattatcattcacataagaaaaaggctccctgtcagtaagccgagatattagatgtgtaaatataatgagccatttgtggagacaccgaccagattgccctgcattgtgatagaattgatgtaatttgagtatcagatggggctgattggtgaatcttgagaagacagttacttgacagcaatgatagattttgaccctgttgtaactggtatacttgaggtaggaagcaattctactcattctgtcaaacggaggcctccactcataaagtgaactattatttagaggatcttgtcttcttggctattattaaaatgcaatttttgtctaatcagctgttattaaaacgcaattaccaaataatatattcttctcactatggtgatttgacagatcaaaagctttctgagggcagagactgcgttatccgtttacgtatctccaatgctttgtatcatgtctggcccattgttagtactcaaaaagtgtttgcggaattaatgaatggttgagtaagttgcttcctataatcaagacttttagttagaatggtggtaaatttagacttagaggattttgtactttgtatcagtggggctgccctaactggtggatttattttttaatgcaatttttttctttttatttaaaatttctttggaagcacagatgatattataaacataataatgtaaataaagtaagaagaaataaattactgattactccaccttccagcagactgtgttgattttttcctgttcatctctatgcatttatatacttttttgtttgcatttttatgacttagaacccagatttgatgtgttatactgagttttctacttaatattaacatttttaatatagtatttaggccaggcacagtgactcatgcctgtaatcccagcactttgggaggccgaggcagttggatcacgaggtcaagagatcaagaccatcctgggcaacatggtgaaaccccgtctctactaaaaatacaaaaattagccagttgtggtggcatgcacctgtagtcccaggtacttgggaggctgaggcaggagaatcgcttgaacccgggaggcagaggttgcagtgagccgagatcgtgccactgcactccagcctggcgacagaacaagactccatctcaaaaaaaaaaaaaaaaaatgtacagcttctaattttacatggctacatagtatattctttactttgtattccccctcaacaatattctatttccctatcgctttatctttctattgaattcctactcagctttcaaggtcccatttaactttgcaacagtcttccaatttctgttgactcttatgatccttgtactttacgtacagtgactatagaacttttgatactttaacttttttctttttatgaaaattatgagaaataaggtacatcagagcatggattacacaactctgtgtcctgatgcctaactcaatgttggtcatgtagttggccctcgacaaatacttgcagataacattctaaggtctgggaatagagggataaatgagatatggtttctggattttatgctcaaagtatattggtaggcaggtaggcagatatcatgtagaaactgaccttctagagttgtttatatggtgctaggaaaaccgagaggaggccagtatattcacagcatagctttttcttcttaataatcttttttcctctactttcaggaatggtatgtgtaggctaaggagttctcacattttcatgactcttcatttcctttggaaattattttctaaaagattccatttcctcatgtttgcttttctcatgccttgtttgcccatgtcacttgctctttttcatttggtatcttgaaatatagtttttcaccacattatataatcttcctacataattgcagcaggcaaagttctaagatgttcctcaagattctccatacttcccccaccaggatacaggccctgagtaatccctggggctataaatttgatggattttacttccatgactaggttatataatatagcacatttaagaaaggaagattatcaggatgggtctgactcaccgtagtcatgattatgactacattaatcctttgaaagtacagttttctctgtacttctggtctacaaacatgtgagctaataaatgaatattgttttaagctgtcgagtttgtggcaatttgttatacagcaataaaagtgaatacaatagtatattaaccatttgtggtatttgctacatatatattttttagtttatcttgctataagttttgtttgtacaaaactcggcttcttcatataattgcatctactgaagatttgtttctttatgatttctagtatttcttcaaagtttagaaggcattaaacagggtattgttggtaggacgcacagaggatttgagtctgagtgtcaaataattaatttgattagactctgccactggcattcttttgcataataatttataaactttcaacctgaacattgactttctccattgctacttagctgaggagaaatacgaattctcctttggaaaagtttggggatttctagaacactaaaccattctttttgatgattgaatggaactttcaaatcttatatttcaacacgaatggggatctcacaatggaaggcagctccctagaactatgctgttagccctttccttcaccataatacttggcaagagacaacttacacagacttttcatttttattctacccttcttccaaattctctggatggtctagcctgtattgcctgttgttttcagtgttgttctgatctcaaatgggcttccacaagtggctagaagggattagttttcatatttcttccattagttcagtattgaactaaaaagcatggttataaatgacaactttagtgactgtgattttttttttttttttttttttagacagagtctgactctcttacccagattggagtgcaatggcgcgatctcagctcactgccacctctgcctcccaggttcaagcaattctcctgcctcagcctcctgagtagctgggactacaggcacccgccaccatgcttggctaatttttgtatttttttagtagagaagggatttcaccatgttggccaggctggtctcgaactcctgacctcaagtgatccacctgcctcagcctcccaaagtgctgggattacaggcgtgagccaccgcgcctggccaaatgactgtgatttttttttttttttttttttttttgagatgaagtttcactcttgttacctgggccggagttcagtaatgcgatcttggctcactgcaacctccgcctcctgggttcaagtgattctcttgcctcagcctcccaagtagctgggattaccggcgcctgccaccacacctggctaattttttatatttttagtagagatagggtttcaccccattggccaggctggtctcaaactcctgaccttcaggtgatccacctacctcagcctcccaaagtgctgggattataggcatgagccatcgcacctggccatgactggatttttaacacccatccacattattggtcactgttggtgcttcaagtgtttctgtaacattcctggattgacactaaaaaaaatcctaaacaagagaattgttactattatggatacatttgttctttcaacttacaaatattaaggacctactgtctgctagctctgcaggcctcgccattttttgccttttccatttgacacttatatgtcaaatagcctgtgctaagaaagtccttaatgctacaaaggaaagtaaatgtacttatatttgttgcctgacttaacaggaatatataggcaaaagctagtagttatgctgaatttaagacagtatgtttggtctaatatccagaattcacaaggaacttaaatttataagaaaaaaaatgaacaaccccatctaggcaaaggatatgaacagacacttctcgaaagaagacatttaaggccaggcacggtggctcacgcctgtaatcccagcaatttgggagtccgaggtgggtggatcacttgaagtcgggagtttaagaccagcctgggcaacatggtgaaaccccttctgtactaaaaaaaatacaaaaaattagccaggtgtggtggtgagcacctgtaatcctagctactcgggaggctgaggcaagggaattgcttgaacccaggaggcaaaggttgcagtgagctgagatcatgccactgcactctagcctgggtgacaagagtgagactccgtctcaaaaaaaaaaaaaaaaaaaaagaagaagacatttatgtggccaaaaaacacatgataaaaagctcagcatcactgatcatcagaaatgcacaacaaaaccacactgggagaccatctcacaccagtcagaatggtgattattaaaaagtcaggaaacaaaagatgctggcaaggctgtggagagataggaacacttttaatctgttagtgggaatgtaaattagttcaaccattgtggaagacagtatggttattccacaaggatctagaaccagaaataccatttgacccagcaatcccattactaggtatataaccaaaggaatgtaaatcattctactataaagacacatgcatgtgtatgtttattgcagcactatttacaatagcaaagacatggaaccaacccaaatgaccatcaatgatagactagataaagaaaatgtgatatatatatatatcacatgtattatatatatatatataatggaatacatgaaatcagaacaccatggaataaaaatgaatgagatcacattctttgcagggacatgtatgaatctggaaggcatcatccttagcaaactaacacaggaacagaaaaccaaacaccacatgttctcactcataatgagttgaacaatgagaacacatggccaccgagaggggaacaacacacaccagggcctgttatgggtggggggtgaggggagggaacttagaggatgggtcaataggtgcgacaaaccatcattacacatgtatacctatgtaacaaacctgcacgttctgtacaggtaccatttttttttagaaggaaaaaacagtatttttatttttataatgtaagtgtgtgataatttgtttaaatctaatattgtttctattagcttaagttaagcattgagacaaaaattggaagcatggaaatgagaaaactctagtaacgattctgtcaggggtgcatagtcattgtgtatagattaggaggtagaaagtgatcccgtcttatgattttaaagtttgaaaggaactgaaggataatccaggccaaatgcttcatgtcatagatggggaaacagagtcctagagagaggaaataacgtactcaaggacgtggaggtcctatgtggcagaaccatgcgtaggaccctatttcctgttactcacttcttttcctttccttgatttgggttgctttgttactggtacttaataattcggtagaaacttgacatgtacttcatgatattaaattgatattgtaggttggactctggaggggttttaggactccttgtcttttctgtgggattgaaacaatatggtttctattaaaatattcagtgacccttctatcttttgaagtatttggttagatgaaatgtggatagtaaccaaaacctctataagtagtattatactttggtctgattgaattactgagcagttttgtattattcttgttgagtatttttggtttgttggtttgaaaaaggaaacagttctacagatgtgtttttttctagtaacttctgactgcttttctattgatctcctttttacgtcaaataataaagctaaaagaagctttgttatgtcttttaacaaaatattgatcttttattggtatgaaaacatcttggttgttaaattgcttcattaattttatacctcttttatattgaagtctgtaattgtttggtgtaagagttactccagttactgcttgttttaaaattgattttccttttaatttagagacataaatgaatcattttttcccctttaatttcttcctgctatataaaagacattaaaacttttttaggctatcaataatattacataggtctttttggataatacagtcctatgttgttggtgaaggttctaaacctgctagtcttgcctagtttcagatattgtctggtaaaataacatcactatattatgcatgcagctactccaatacatatggaattcaggaaacttggatttgaattgtctctcttttagttattatctgtggcaagtcacttagctcctctcagtatctctgtttcctcatcttttaagtggagacaataagatttttagagtccttgtatggactaagtaagataaagcatgcatccctggcacattgtcaatgctcataaatagtagctgtaaaaatactgcacctagggtaaactatagaacagtatatttattctgaaacattattcctgttagctattatttaattcacccagcttactttcctcatcagttaatctgtaacccttttctccttatataaaagacttggaattatttcattgagggaggtcaataagaagattcccaaggaggatctgattaaagagtatctattttccccatgataagatcaataattccttctcaagggggtgtcagaacgaatatttgaaaattaccttccaacaaactctttctttgcttctgggaatagtacatatttggaaaggagacaataaatagatgggcagtatcttgtgcaggagttctgaacaactatagaatgcttccatctgttcacttttcagttttgttctccttgactttcctatcttagactcctgaggttgttagatgcacccctctcatccacacagtgactgtgtctatctatctggcccataaaactcctttccagtatgtgagaaatacatccgttatacaggattagagacagtggcatcgtcttccacactgtagtttaactcaggcctggcaccaaactagtgttttttgatgaggttgttatcaggcaagagaatgaagctagttctgtagtatggtaccacagagaaattagcctgtttcatgaacaaatgcagataatagggtacataatttttagtacttgaagcatagccatgagtgtaatctgattgtcggaaagtatacaattcttaacctatggcccttattttaaccaaacatagtctgaatgttacaaaactttaaattatttatagaaataaagtcattttatcattgattatctgaagctcctgtttttgtccttgataaatcatataggacctttagttacctctccaatttgcactctctctgtatttctggacatatcaacaaactatttctcagctgctatgtggcattggtcatactgtttctctcctacccaaatgctccttgctgaaggagcctcaccttcatcagcactgcagcatccatggtaaagatgtagggaagacaactaagaccccagctccatgcttcacctggtcacctaggccctttgaagaaatcttgcagtgcggcataccattagtctcccttggacaagaaaatataaagtcctgcctccctagataccagcctacctaacgaagccttctaaaatagtgggctttagaaaatcaaatctcgtatctgaagatagtggtaatcatcaatgtttcagaaaggtagcatttctggcccttgagtgcacttataaaggttgatgaatgtcagtggtttctggcaggtttaatgcttaggcaagggaaggaagggaggaatcaaggaagaataggaaatagtgaagagagtaagtaaacagtggggaaataaaaatatgtctgtgatcagcagtggtaaaattcccctgaaatttgttagagatacaacttagtagttgcctgaagatgcttatctttccctagtggtatttaaaatctctctctcctgccactagcattttagttctttctttcttctttcatgtatgtttaatttttgaaaataattggagatttatggtagtatcagtggtattttttccattttttttctcttgaactatgttttctttgctccaaaaagcaaatggcagtcttcaaaggacgatttgtttctatttgtataaattgagtataagctgcatccaattcctagtgcatgcataaaactctttttgaggaaatgtgaccaatatataacattttattgaatgtttcttgaaattggtgtcaaactgttttttatttcatttcttttgggatgcctaattgaattgaaacttcattatttcattccatggcttaggccacctttagagggaatataccatgtgagctcctacttacccattaagaccagatatccactagggacttaataggctaatgtgttcctctttcacctcctatgtcctaaatttagcattagctaaattgactaattaaaataaccctagccttattcctcttcctagtggatattgttttatttaaacatttcatcacagaacttggtacaattgttaggcacttcttacatgatcctggaactgaaatgtcagatgcgtgtagggtattataacctaaccaaccataatgagataccaggatggctatgattaaaaataaaggaagtggtgagaatggaataaaaagtgctgcagaggatgttgagaaattggaacactcaaacatggctggtaggaatgtaaaatggtggagccactgtagaaaacattttggggattcctcaaaaagttaaatataaacttaaccgtggaatgacccagccattccactcctaggtataatgcccaagagaattaaaaacatatgttttcgcaagaactttcacatgaatgtccatagcagcattttttgtcatagcccaaaagtggaaacaactcaaatgttcatcttctgacgaatggatacacaaaatgtggtctatccatacaatgaaatattattgagctatagaagggaatgaaatactaagatatgctacaatgtagatgaatctcaaaaacattgttctgagtgaaagaagccagacacaaaaggttacatattgtaggctttcatttatatgaactatccagaatagataatggaggcagaaagcaaaatggtagtagccaggggatgacagaaggaggggatagggagtgactgtttaatggatatgagatttaatggatctgagatgaaatgtcttgaaactagataaaggtggtggttgcacaacattttgaatgttctacatacaactagatttcacttacactttcaaaaggttaactttatgttatataagttttacctcagtaaaaaataagcaaactcacagaatttagagtgaaattctaaaatcttgacagccacttgctcccttcattttttcgggactaatcttgtataatttcaggcttaggctaccttgttggggtaagatcagttttaaaattcataatgctttttttctaaaacaaagtgttcagtaaagataaacaaaaagaaaaattagaatcaccataattgtaccactcagaacaattcttaatatttttgtatgtgtatttcctgtgttttttccagtgtgtaatatatgtacacatactctatacatgcatgtacatatttgtgaaatagggtcattttgcatatagtgtttataacatacttttatcatttaatgatgcattagaaaattatttggtctattttctatagtttcacaagtatacagcataactcttttaaaatatgtcttcagaaaaaaaaatagcagcaaaatagggtaaagatcatgtttcatttgtttttgaatccctggagttgttcaaaagaaatagccactttattggattgggttggactggattggattagattgaattaaactagaataacttctagaaaccaatgaagaacttctgaaatattcaacatcttgttttgttataatactctcttagcttcattttagttggtgacttgatatacccctttttcccttcagggtgtcaggattgtagaagcctgagtgttacgtgaagcaaatgtccccatgtattctgttttagtttactatagctgccacaacaaaataccatagatggggtgacttaaaaagaaaactttattttctcacagttctgaagggtggcagtccaagatcagaccagcaggtttagtttctcctgaggtctttctccttggcttgcagatggctgccctcttgctatggcatcacatgtccttttctctgtgcatgcgcttccctggtgtctgtatgttctcatctctactttttataaggacatcagtcaaattggatcagggcccaccctaatggcgtcattttaacttaattacatctttaaaagccctatacaaataaaataaacacattctaaggtaatgggggttagggattcaacatatgaattttgggggtccatgtaggcatacctcatttattgtactttgctttattgcgttccatagtgtgggtgtgtgtttgttaattttttaaagcaaattaaaggtttgtggtaaccctgtgctgagcaaatctgttggcactgttttttccaatagcataggcactttgtgtctccatgtcaaattttggtaattgtaatatttaaaagttttcattaaaaatttaaaacattttcaattattatgggcacataatagttgtgtatatttctttttcattattattatatctgttacagtgacctgtgacaattggtctttgatgttaccattgtaactgttttggggtaccaccaaccgcacccatagaagacagtgaacttaatctataaatgtgtgtgttctgactgctccatcaactggctgatccccagcctctttccctgtcctcagggctgcttattctttgagaaacaacagtattgaaattaggccaattaataaccctgcagtggcctctaagtgttcaagtgaaaggaagagtcacatgtctctcactttcaatcaaaagctggaaatgattaaacatagcgaggaagacatgtcaaaaggcaagaggccaaaaatgaggcctcttgctccagttgggagagttatgaatgcaaatgaaaagttcctgaaggaaattaaaagtgctactccagtgaacacatgaatagtaaggaagtgaaacagccttgctgctgatatagagaacgttttattggtctggatagatgatcaaatcagccacaatattcccttatgccatagcctaattgtaaggccctaactctcttcaatactgtgaaggccaagagaggtgaggaaactccataagaaaagtttgggccatagtgtgcaggtagctgtccctacttgcttcttgctgaggctgcctcagaacccctttccactgcttcatgattttctgttgtctcttggcaaaaatggcaaataatgatgctgttctgaagaggctggagcagaaggaggcagaggtgggtcaaatcattgaatatcttaagcagcaagttgctctacttaaggagaaagccatttttgcaggcaattttgagggaagagaagaaactttgagtaggaaactgaaggaagaagttgaattgaaacaagagctaattcagacagaaattcaaaacagaatgaagcaaataccatttccatctggtattccactgcatgctaattatgtggtttctgaacgtgatacaatctacaccagtaacaaccacatcttctggtatcaaagaacagataaaaggaggagcaggagaagaagagaaagcaaaagagaaaattgaagagaaaggagagaaggagaaaaaacagcaatcaatagcaggaagcaccaactctaagccaataaatgtttcccaactagatctttgaattggttgcatcataaatgtcagaaaacaccctgatgcagattctttgtatgtagaagacgtagttgttggggaaatagtcccaagaacagttgtcagtggtctggagaatcatgttccttttgaacagatgcaaaatcagatggtgattttactttgtaacctgaaacctacaatgatgaggggagtattatctcaagcagtggtcatgtgtgcttgttcaccagagaaggttgaaatcttggcccttcctaatggagacaattacttttgatgctttccctggagagcccaacaaggaaccaaatcctaagaagatttgggagcagatcccacctcatttttatactatgatgagtatgtggctatatacaaaggagctccctttgagatgaaagggaagggagggtgtagggttcaaactatgaacaacagtggaataaaataaaacaaaatgccttcattatggaaatacattggagaaaaccttataaaaaggaatgtatttgccacttgtacctaaaaaaataataacaacagcaaagtttgaggctaccagaagtttatgaggtttaagaaaagaagctatgtccataacataaaagtgcaaggtgaagctgcaagtactgatgtagaagcttgaggcaagttatccagaagacctaggtaagataattgatgaaggtggttacaataaacaacagattttcagtgtatatgaaacagccttttactagacgatgataccatttaagactttcatagctagagagaagaaatcaatgcttggcttaaagtgtcaaaggacagggtgacactcttggtaggggttaatgcagctggtgactctaagttgaagccagtgctcattcaacatttacaaaatcctagggcccttaatattgatgctgaatctactctgcctgtgttctataagcagaatcacaatgcctggatgacagcatatcaatttgtggcatggcttactgaatattttaggcccacttttgagaccagctgctcagaaaaaaagattcctttcaaaatattacttttcattgacattgcaactagttacccaaaaattctgatgaagatgtacaaagagcagtcatgttaacacaacatcaattcttcagcccatgcaccaaggaataatttcaacttttaagttttattatctaagaagtatattttataaggctataattgccatagatagtgtttcctttgatggatatggacaaagtaattgaaaagcttctagagaaaaaagtaaccattctagatgccattaagaacacttgtaattcatggaaggaggtcacaatattaacacgaacagaaatttggaagaagttgattctaacccttgtggatgacttcgaggtccatccaagttcaaggcttcagtggaggaagtcatagcagatatcgtggaaatagcaagaatattagaattagaagtgaaattctaaagatgaactgaattatttcaatcttgcaataaaacttgaactgatgaggaattgcttcttatggatgagcaaagaaagtagtttcttgagatggaatctagtcctggtgaagatgctgtgaatattgttgaaatgacaacacagaatttggaatattacataaacttagttgataaagcagagcagggtttgagaggattgactgcaaatttgaaagaagttctactctgagtaaaatgctattaaatagcatgacatattgtagagaaatctttcatgaaaagaagtaaatcgatgttttaaatttcattgtcttatttaagagattaccacagcaaaaccaatctttagcaaccactaccttgatcggtcagtagccatcaacatcaagccacgaccttctaccagcaaaaaaattatgacttgctgaggactcagatgattgttagcatgttttggcaataaagtattttttaaagtaagttatgtgcattgtgtttttagacataatgtcattgcacatttaatagactacagtttaatataaacataattttatatgcactgggaaaccaaaaaatttgtgtgactcgctttattgcaatatttgttttataaaagttgtctggaactgaacctgccgtatctttgaggtatgcctgtaattcggtgttcataaaatatacccaactgaggaagacaatgtcattgtgtctacaagaatcttaccatggggactcagttaaagtgagtcacccaaatctatcaagaggtagattttcttacatttttatgaatggctctgattagcagaggagaaaattgataaaaaatatgtgtggcaagaatagtagaaaaaatgttggacattttttgtttttaaaccaagaaaatatctaggctgggcacggtggctcacacctgtaatcccagcactttgggaggccaaggtgggtggatcacctgaggtcaggagttcaagacaagcctggccaagatggtgaaaccccgtctctgctaaaaatagaaaaattagccgagcgtgatggcgggagcctgtaatcccagctactcgggaggctgaggcagagaattgcttgaacccaggaggaggttgcagtgagtcgagatcacgccactgcactccagcctaggcaacagagtgagactctgtctcaaaaaaaaagaaagaaagaaaaagaaaatatctaccgttagcataggaaaattcattatagcagcatattcccactattttaatggcctgaagagaaatagcactatattagcagttcataattaacccataagcagggcttgttgatcagtattttttgggaaaagaaggcttcacagtcgggattttttggtgctaaacagaagatactcctttcaaataaaagcaaattgggataaatttgtcattttttggagataaattatgaacattttagattagtagaatcttcctaatgatgaattccatttcaaggacaagttttgtttaaattttatcttcaagatctgtgaatatagaaaatttaaaataattgtgttttttttgtttttttttttttttcttgagacaggctctgttgcccaagccagactgaagtagctcaatcatagcttactgcaaccttggacttttgggttccagtgctcttcctgcctctgcctcctgaatagctgggactgcaggaacgtgccaccacacctggctaattttaaaaaattttttagtagagacagagttgcctgggctatgttgctcaggttatggaagattttttaaaacctgttttcatattggataatgacttctttaaatgtatactcttcacttgagcaggggataaagagttgttttctgaagtttggcttgagaaaacaactgtttgggttttaaaatccaagtggaaacatgttacaaatgaaatttttttttatttctcttatttaaaacaaacatagtttatagcttttatatattaacaatcaaatagcagaaccatctacatttatccaaaataagctagattagtttgtgtgtattttcatgtaagtcaaataggcatttgcttatgaggagtcatttaaatgcagctttacaagaagtggtacaattgtctgcaacatttctttatctcaaagtaatttggatgaaataacatcagaagatgtcagtttaaatgttccacttgaaatccggttagtttttgattattcacactaatggaaggagagtgtaggcatgtagactccgaagagacctttaatccaaaaattacttcttagcatttgaagatatttgggtaatacatttggataatggtgtgtttcatgtcctttggcttttttaatttaaaaaattttttcagagacaggatctcactctgtcactcaggttggaatacaatggcaccatatagctcactgcagcctttggtttaagagattctcttacggtttaagagattctcggccgcgcgcggtggctcacgcttgtaatcccagcactttgggaggccgagtcaggtggatcatgaggtcaggagatcgagaccatcctggccaacacggtgaaaccccgtctctactaaaaatacaaaaaattagctgggcgtggtggtgtgcacctgtagtcccagctgctggggaggctgaggcgggagaatggtgtgaacccgggaggcggagcttgcagtgagccaagatcacgccactgcactccagcctgggtgacagagcgagactctatccaaaaaaaaaaaaaaaaaaagattctcccacctcagcctccagagtagctaggactgcaggtgtgtgccaccacacctggctaattaaaattttttttttgttgagacagggtcttgctatgttgtctaggttggtcttgaactgctgggctcaagcgatcctcctgccttggcttcccaaaacattgggcatacaggcacgagccaccatgccagacccttttggctttattgacagcctttgaattttaagtaaatgctgaaatgtatgtagcttactggaatatatataggagactttatagttctttctttagatctttggatttccttaagagacagagcactttacaagaccttttgtttctcaaatatacatataaacagcaacacatttgaaagataaattccaactaatgattaatgttctttgcagagaatgacaaaatacatattaattacttagggttctatttgtattttactttcatagttagaaatctgtttctttttctttcttttttttagaggcaagattttactctggtgcccaggctggagtgcagtggctcaatcttagctcacttcagccttgaaccccccagcctcaagcgatcctcttttctcagcctcctgagtagctgggactacaaaaacatgccactgtgcctggctaattatttttatttttatttgtagagttggggttgctttgttgcccaggctggtctcgaactcctggtttcaagtgatcctcctgccttggtctcccaaagtgttgggattataggcatgagccactgcacctggccagaaatttgtttaagtaaaatgactgtatcagtcagggttctccagagaaacataacatatgtgtgtgtgtgtgtgtatatgggactggctcacatgatcacatgattatggaggctgactagttacaagatctgcagttggcaagctgaggagggttgttagcctttttgttttattcaaaacatcagttgattggatgaggcccatcccattaccctgaataatgtttgcccaaatgtctgggcaccttttggcccagtcaagttgatacataaaattaaccatcacaatgacctaccttaaagttcttagctggacattttgcatttctcatcaggaacctaggctaatttacaacctttgatattgatttcaaccacagtacagttaatgagttatcagtgatgacaaatcatgatcatttccaatacaaatattaactctgattatttgtaaatatgttatttttcccacattgttctagacagtgggacatagaggtaaagtaggtaaaggtgctcacctcctgtaacttatattccagtgggagtgacagataatgcccaataaacaaataaatgtatattaaaatgtcaggtagtgataagcataatgaaaaaataaaacacagtaaagaggtaccatttcagataggtttgttaggaaaagtcctgaatgggtgacatttgtacagagatgtgaataaagtgaaggaacaacttatgtataccttgataagcacatatctaactaacatttttggcatggtttaaggtctttctttcatatatctgtattttgcatactgtggtgctactcagatatcccttctatgaaagcttgttgccccaacttctgggaatacaatgggcaggtaccccacagctgtcagccccttcagggactctctcagctgcagggcgccaacttgactaactaaggtaaccctccttcccaggatggcccacagtcaatgactgattgctgtggaaatatagagtcctatctattttggcccagctagagataactctgaagggccattctaactccagagttccctgcgggatgagccaagactgttggtagatttggatgacagtttaactttttcctctgtccaaacctgtttcattcccctcccttttcataggtttgatcccaaaggtactccttaatatacctcctgctaatcttggtctagaggtctgcttcccagagaactcaccatttaatatgaagttttgtgaacctacagcttatttatgatcttatctcagtagtacttggcagctggttttatatcgggccacggtctgcttcctgacagaatcttacatgttaatatgaacctttcttttctgactctagcactctgaaaactgactttatacctaccacacagtttggaaattgttaaaaaggttatgattcccctaaccactttgatcttattatttcactgagagatattttagaagcattggtttatcttcactacctacaggagtctaatatattgttttatttaactagagtctggtcaacattaacctctttttcgtttataaagagaatgatacggctgggcgcagtggcccacgcctgtaatcccagcactttgggaggccgaggcggacaaatcatgagttcaggagatcaagaccatcctggccaacatggtgaaaccctgtctctactaaaaatacaaaaattagctgggcgtggtggcgcgtgcgtgtagtcccagttactcaggaggcggaggcaggagaatcgcttgaaccaggaagtcggaagttgcagtgagccgagatcgcgctactgcactcccgcctggcgacagtgagactccgtgtcaaaaaaaaaaaaaaaaaaaaacagctacaaattcatgtcaatgaatagggattttcaaattatcttcatgctgcaaaaggagagaaatcactttataacttataaccatgaagctatttccattaaatatttaagaaacgcaaaattcttggtaatggcaacaaagttaaacaagttaatatgggggatttttaaaagcaactatgtttaattatttcagggtttcatataacttttgaaaaattaatatatgatataaattcccatttactgtgtaattggtattatttatgaaagaacttcattcttcctgtatcaagaaacatagggattagatttgtaatttacataatctataagcatcatcatgaattcttttcaaacctgacaccaaaagtattttaagaaatctccataccaatatctgtcatggacatagatatacacattctttataaaattttagtatatgaaatacagaaatatatacagtgataataaatcatgatctagtagagaatatcccaagaatttaagattgattaaaatttgaaaatcagtgtaattaatcatattatcaggcttaaaattaaaaaccagccagatgctatgtcacagtgctttggaagattcagataggagaatcacttgaggccaggaatttgagatcagcctgggcaacatagggagactctgtctctacaatttttttttttaaataaattagctgggcatggtggaacatgcacctgtagtctctgctattggagaggctgaggtgggaagatcacttgagcccaggagctcaaggttgcaatgagctatgattgcatcactacactccagcttgggtgacagagcaagactctatctctaaaaaaagaaaaaccatatattcctttcaataaatacaggaaaagtggttgacaaaattcactatttgctcatgataaaaactcagaaatctagtattagaagggaacttaagattccctaccattgatgtgaatttgtgtcattctctttataaatgcaaattggaagggaactttagggatatctctgaaaaactttcagttaacattgtacttgatgaaagactgaatgctttctcccttagattggaaacaatgtaagaatgtccatgctcaccatttcaattcaacattatgctggtcctagccaatgtaataaaggaagaaaaataaataaaaggcagaatggaaggacataagtaaaatagtctttatctacagatgacgtgatcttctattagaaaattctaaggattatacaaaaatgctgctagaacaaataagtgagcttagcaaggtctcaggatacaagattaataaagaaaaatcaatcctatttctatatagtagcagcactcagaaatttccatttccaagtgttattttattaaaaaaaacaactcaaaatggatcgtagacttaaatataagcacaaaaaatgtgaaagttttagaataattcatagaggaataaaaagctggagttagccgggggcagtggttcacgcctgtaatcctagcactttgggaggccgagacagacctagatgtaaattccagacttgcacttgaatcacgttcttgctacatattatctatgcaatctctgttaaattatttagtttttcttagcctcactttcttacctataaaatggagataatatctgctaggaactgttaatgtaaggcagcggttctccaagtacggtgcctggaccagcagcattagcaccacctagaaatttgttagaaatggaattcagacctactgcttcaaaaactcagggtgggtcacagtaaattgtgttttgcctttcaggtgattctgatgctcaagttttagaaccattgatgtaaggattgtgtgtattgtgtgctgagtttcacagtgtttgctatgtactaggcacataattaattttaaaaacaaatgtctaccccagcaaaccttctattctcttcccttacactatttcttccagaaatgctttccccatttttctgaaccttaacattctttcaggacccaactcaaattccatctgcccccagaattcattccaaatcataataattctctatccccaaaacatagcacttaatagctagaactgttggtgctcactggtaaccactagccacatatagctattgagcacttgaaacatagctattatgcattgagatgtgctttaagcacatctcactggatttcaaaggcttactacaaaaaggggatatacagtcgactcttaagcaatgcaagagttaggggcacagacgttctacacagttgaaaatgtgtgtataacttttggctctttgaaaatttaactactactagcttactgttgacctccagccatactgataacataaacagttgattaacacatgttttgtaggttatatgtattacatactctattcttacaagagtaagctagagataagaaaatgttattaagaaagtcataaggacttataaggaaatgtatttactatccattaaatggaagtgcagcattataaaggtcttcatccagtgagttttatactttcatatgttttcatgttactaaccagcatccttttgtttcagcttgaagaactccctttagcatttgttgtaaggcaggtctagaggtgattaactattgtttgacaaaggcaccctgaatacacaatggaaaaaggatagtttttttcaaaaatgatgtcgtgaaaacttcatatccaccatgaaaataagagaaatcatattcttatcctacatcatatacaacaatcaactcaaaatggattaaatatttgagcatataacctgaaactgtgaaactcctagaagataacatagggaaaaatctccatgacattagttttggcagtgatttttaggatattacaccaaaagcacagacaataaaagtaagaataaacaagtgggactacactaaactaataggtttctgctaagcaaggaaatagcaaagtgaaaaggcaacctatggattggagaaatatttaaaaatcatgtatctgataaggaattaatataaaaaataagaaacctgtacaactcagtaaaaacaaaacaccaaagatgggcaaaggacctgaatagaaaactttccaaaggacacatacagatggccagtagttatattacaaggtgctcagtcatcagggaaatgcaaatcaaaaccacagtgagatatcactgcatacctgttagaatggctattataaagaagagacaaaagaaaacaagtgttggtgatgatgtggagaaaagggaaccttatacattgttgttgggaatgtaagttggtacagccattatggaaagaaaacagtatggaggttccttgagaaattaaaaatagaactcctatatgatccagcaatcccatttctggggactcatctgatggagatgaaatcagcacattgaaaatatatttgtacttccaggtttattgcagcattattaacaatagccaagatatggaaactactgaaatgtccattgatggatgagtgcatacagaaaatatgctatttatatgcagtggaatatcattcagcctttaaaaaaaaggaaatttctgttatttgtgacagtagtgaaatacattatgttaaatgaagtaatttaggcacataaggacaaatactgcaggatctcatttatatgtggaatctaaaacagttgatctcatagaaattttagagcatgcaatttagtatgtacagcatggaatagtgattgccggtggctgggtggggggaaaatgggaagctgttggtcaaagcatagaagctttaagttataaataaattttggagacctaatgtattgtatggtgactgtagttaataagaatgtacttgaaatttgctaagagaatagatcttaagttttccacacacacacacacacacacacacacacacacacacacacacggtaactatgtgagattacggatgtgctaattagtttgattgtggaaatcattctacaatgtaacatatatctaaacatttggtacaccttaaatatgtataatttttatttgtcaattatacgtcaataaagctataaaaacttttctgttctgaaggaaaacataaataaagattatattttagaagagtaataagaaataaattttcctggataatttcattgttttctctacaaagaaaggaagaaaataccttttccattaaaaacaaaaagaaaatatctgatgtgcttagtgattctgagaagtcatttatgataaacacagcaaaataatataaatattatgttacctctttatcatttagaatatttttgagtttggcattatacatagtctcaaactcctgacctcagatgatccacccgcctcagcctcccataactgctgggattacaggcgtgagccattccgcccagccgccctttaatctttataacaaatatgcatcataggtgttatctccttttatagatgaagaaaggcaaatgttaagaccaaaacaaaactagcaagtggcagagctaagattcaaacacagatatttctgactccaaaacctatgtttttaactgtactgcaccatagagaaaactggttttactcatctgttcctattttatggatggggaaatttccccatacttatatattttatgtagaaataagaattgtaaacaattttttaagctgtaaggtgacattattgatttgtattttttgcaatagtggtataatttcaatactcctgtaaagtttgaggctctactattttgagataaacagaatataaaggacaatatttaatcaaatctgtgaaatagtaaacagaatattttgtaacagttttcatatgcacagcatattacaagaaagtcttgagttacagattgaatattcccaatccaaaaatccaaaatctgaaatgcttccaaatctgaaagtttttgagcaccaacatgacactgtaagtagaaaatttcacatctgacttcatgtgaagggtcgcagtcaaaatgtaggcacacaacacaaagcatctgcaaaggaaaaataaaattgtctttaggctttgtttataaggtatacacataaaaaattaatgtattaagtgtttagacttgggtcccatccccaagatatctcattttatatatatgcaaatacgccaaaaatctgaaaaaaatcaaaattcaaaacacttctgtctcaagcattttggataagggatactcaacctgtagtaaggaagatgcctgtagttgataaaatattaagtttggtgggatttaatgaaataaaaatactgtgacatgattcatgcaaagtggtttgtcatttactaggattttgaccatttctaggtaaactctggctttcttacagagtagatgttcagaatatgaatttgcatttactgtttttaaggaatgatcactgctttcattacactataaaaacatgtaaatgataaactttttaatgtgaagaggtagttttttctgttattagttgtataaacaaatgcctgaagatatagttgtaagaaggttcccaaaccaatattcttatcttgattctgagcatagcatttgatttggcctgattcatacaactagaaaggggttaatgtttatatagggtgagagctctgcctataattgttacatatcttgcagatgaaccctgtatttttaatatacatatacccatatctttttagtcttaatgttttaaagtatcaactttcttttttctttttttgcttgagagggtggtaggatagagcttgtgtgtacctcagctccagctgctgccgaatgacttccaaccaacacctgtgggtgggagctggctggttttcctttcattgtcaagcctgggcatactaagggaaaatgcacctgccagagacctctttattttcgaaatgattatcagtggtatcggccgagagagaggcagctggtgggctcctgtaccctatctagccctctatatggatctttccttctatgttggaaaaacaaagttgaaatttaccacattttggcattacacttggcagttactgtgatgaagttgatcatattagagagtcattcaggatacctgaccttcctgccttccgctaccttaagtgaaaaatctcttctgttccctaatttactgtagcatatgcttcagtgtgttgtgttgggtagggcagatatccttagactaattctaatcctgagtgattcaagactattccagtggcaatggaattttacacctatttagtcatttggaacagagaggtatctgcttgtaataggccaagacaccttaattcctcatttatccattagctacctgtggggctttatctaagacacttcagtttcctcatccataaaataggaacagatgggtaaaaccagttttctctatggtgcagtatggttaaaagcataggttttggagtcagaaatatctgtgtttgaatcttagctctgccacttgctagttttgttttggtcttaacatttgcctttcttcatctataaaaggagatacacctataatgcatatttgctataaagattaaagggcggctgggcgcagtggctcatgcctgtaatcccagcaatttgggaggctgaggtgggtggatcatctgaggttaggagttcgggaccggcctgtccaacatggtgaaaccccatctctacaaaaaatacaaaattagctgggtgtagtggcacatgcccgtaatcccagctactcgggaggcggaggcaggagaattgcttgaacctgggaggcggaggttgcagggagccgagactgagccattgcactccagcctgggcaacaatagcaaaactccatctcagaaaaaaaaaaaaaaaaaaaaaaaaaaagattaaagggcatcatgtatgtaaagagtacagaggagggcacatagcaagcactcagtaccttataacttttattattctttttcagcttaaaaaattatatgtctacattgaattcatatttattcatgaatgaatacatacgatgttttctgtgtgccaggtcctgttctaagcatgtttcaaatattgtctttatttgatctgtatggtatcctgtaaggtgaggacttaaaatattcccaatgtgaaattgtgaaattgaggcacagacaatctaaaaacttgcccaaggtcacattgctggtaagccactaagccagatactttgaaaatagtattagcatttatattatataaaatctcttttagtttccctttttttcctaatagtgcaagtttattcaccatgtttttagtttttctcaggaagatttaaagaagtgttaggtggtggccttggtgcttcagtggctatcaggtcagccagaggtgactcgtttttgtcaccagggtgtgctgtgattccaccagtctgaacttactgcagctgctgtgaagctggatgggaatctctttattgtctttgctgctgcttagcgaccacaggtttttcagcttggcgctttaccatcacctgggcaactgcctgagatcccaagttattttctttttgtgttgtaccatcctttcctgctcatttgtgtcctcgtgtaaatgaaggagctagcatgtctggcttgttagcagagtgcctagatgcccgagctgtatgttgtcaagcattatgaagctgccaccacacttattattttgctacataagaaattagtatgtcaccaaattgattgctttaaaaaatttggtatcaatagcattttgttaaacttgccactgcctttagtacttgcatctttggtgctaagttcctgatgaatttggaattaatcattaaaaatgcacataggcttgataaacttctataaaatattaatattttctatagaatataaatttttcctatagccaaatactccgtcattatgaataaatgttatctgagattctgtttataaaggatcactttctattcatttgtggcttaaaagagatacttatgtctatgtagtaagaattatgaaaagagcatagattgatttaaagtcttaagagtgtgggtgtacatgcatgcacacacacgaaatataatagggcagcatctctggcagactaatcttgctttgtataattaagaaaacttttcatgtctttcatcattctttttttctaaaattgaagtcatctcttgatggttatcatcctagaaaatttgattagtaggaagcttaaacaaataaccaaaatgaatttattagcatggccatgtgatgttggctttgtacattgttttcaatatatgtattaatctgtagttttccttgaaagggtacttgtttctacatttttatagagagtttctcagaagcctgggctgtttagtgagaaatcttgggaaatgccttaccttactttagaaaagagacttatttctccagataacactgtctttaagcaaacagtgtttgtgtaaccaccttgtagcaacattcagcttgaagataatagccttcacatgcttgataaaatgatgaaatcactgaccagcaggatccgtcagtggagtcagcattttatcacaatgtgataattctgtttaatgtggaaatggttacaaaatcttctgatatgtgtggaattcctgtttgatgaccacttgcttggaggaaaaaaaaaacctgtgcaagaaggtttagtgtgtttatttcattgtaaagacatttctgaccattttctttaattgaatagcagaagtgtatgttggttcatacactttgaaatgtaaagtttctgctcaggccattgtggaatgagcatcttccattaatctcgcttcacactaaaatgagtaagagacttatgattttttgaactgcatgtttaaattgtaattttgctggaaaagttaccaaatgaaacatttctgaagaaattaagataattagacaagacttatgaaccacacagtgtcattatttttttaaaaatatatagatgaaagactggacaaagttcaattctgcattaaggttcctttcaaagtcaaaataattaaggtaatcaagcctcacactgggcaaaggtttttttccctcttttaatctgattgacttttttttctatctttgttttttatgaactcatattttttaggagattttagggagaaaaacccagtgcctagatagatgtgaatgatcatataccaatgaatgccattagcctgttttttcatgttctttacttgtgctcttggaaatttgagtgtcttaaataattggaatgcatataaagacatatttttttctatgctaaagaaaagcaaaaactttgaaattttttgataagtggaaatatagatattacaaagaatatattacacacttctaaatctaaatttgtcaatcaccgctttttataacttaagtttttggtagaagtatgttagcctttagttttgtactggaatatttttagggctatctgaccttctaggttttcttatcccctcagtctgaccttccacataacctgtttctgttcatttattgatctcctaccttttacatatggattgattcacttttcattcattcaactaatatttattacctgcatgtatttgcctggtccagaactggggtgagatattggccataggaaggtatgatcctattgtctgttcttacagcacttatggtctaaccagggaaagaaaaaacaaataattgaatttacagttaattataattttaagttctatagtattcttaagcagtcatttttttacatctccacacaagaggaaattgtgtattccttcagcgacctttagaagcagcctgcatttttttgtttgtgaggatagttgagggtggggagagactacactggtatgttatttgtatataatgcacagctttagtggtccataattatgggggtgttgcccattgtactgtatgaagtttttcacctccagactatgccttgcttctgtagatttctctcagggctcatcatgttcgccactctctatctcagttcgcagctccatttccactgcttgccttttctttaaagataatcatggttttgtccagggctttgccttatcctttggttgagaagatatcctctggatttccccaattcctccaggttttcctaccacatcttccctgtaaccatgagtgccttctcccttgtatagatacattaattatgaattactatatacctctacaaaaaaagcactgtatgtgtccctctgcgctaggcttaaagggaatttaagacaaaggtgaatagatttgtttcaccacagtttttttgtattaactaattaactttattttatttttgcctttttctacatgttctaaaccgccccacctcttttctcaaagaatttataacctcgtctagtgtttgtggtaggtataaataaatgttagttaacatcatgattatattttgtgtatgccccagcccacagttggagttcagaaaacattgattccattaatttgtgtttatttttcatagatttctaaataaatacaaatcttttagaaaatattgactcttccatttgtgatcattatgcttgaaatcactaggtagaagatatgtcctggggaatatcagaaacactagttttctagtgttttcttactggtaaagccctaggtaatagagctttaatagcatgaatctccagaaatctaaagctaactttaattcttttcactttctcaaaactatttgcttcaatagttgaataatatttacaaaatagttaactaatttgaaaactacacacaatattgctattctacttgtttctcacaattaaattctctattagaaatcctcatggagagtttgagcttcctaaagatttattgtaaatgtacaaattttccaaaacaaaaaggcaattaaatcttctgaaatttgaacagttaattaaaatcaatattaacgtaatgttaacataattgttttgtgcatattagtttattggaagtctgtttaatcactgcctgggagactattgttttatgtaaaccagtattctattgaacggttcctttttttgtaagactggttacagttttatcccctttaaagatttctgtaagtggccaggcgcggtggctcacgcctgtaatcccagcactttgggaggctgaggcgggcggatcacgaggtcagaagatcgagaccatcctggctaacacggtgaaaccctgtctctactaaaaatacaaaaaattagccgggcgtggtggcgcctgtagtcccagctactcagagaggctgaggcaggagaatggcgtgaacctgggaggcggagcttgcagtgagccgaggtggcgccactgcactccagcctgggcgacagagcgagacctccgcctcaggaaaaaaaaaacaaaaaacaaagatttctgtcagtatcgggttgctctgcgatttagtggttggccttgataagctgagtgcaaactgtaaatttgttttctagttctgccccttctccactggttgctgcttgtgtggatcaggtttccttctgttctagttagctgtaggcttgggtagaattcagcagttaattggagggagggagagagggacaagaagagaggctccacaatccagttgctggtgtatgtcactgtagaatccactgactgatattttatcctctggaaattataaaatcctactttaacacctacttttctctttgctgatggagaaatcagggaaatcgtggagaagtcttttagattgatgctaaaagatggattgatacttctttcatcctatcagccttttagattgataggatgaaggaaggttcatcaagtttttccagacatcaagaggttaaagtcccttgctggacgggaggtagagggtcaagtggctaagtagagaatgcttatagagcagtgcttctcaaacattgccatctatcacagtcacttggagagctaatagagaatacagtggcccaggcttcttgacataggccagggcttttgtatgtatatagtaagttccctaggtgagtctaagcttgagaactcctgggggtgagagtatctccagtcagcttttcctgtagtatggtgagtggtaaaagggaagccagggacagtgggatggaagaaggactaacatctgagggcttcttatgtactgggtaatgaggtaggtgctttcaggtgttatcacattgaatcttcacagcaacacaatgctgtagatattgcttcttttttatagatgagcaaactgaagttcagaatagataaatacatttcccaaggtggcatagtgtgtaataatcaggatttaaactcctttgattctatttgaattcaaagaccatgttctttccttgccattcattccttcagcaatagaagttgagcctcagttttcttatctgtaaaatgagattaataatagtaactcattgagttatgaaaattaaataatatatgctaagcacataaagcagtgccaggtacttctgtagtaagctcctaatgttaactatcatcattatttaaattatactctagttcttgctatgggacagttatgatgttaggggatggggatacaaagatgataagatattacttgacctcaggtagtttaacaatagtgggaagacccgacagttgaaagtagtatgttatttctttttggcatccattataaaatatgtgagtaaatttagatagaaaagcaaggaatgctgaaattcagagatggagcctgtagtggcgtgcatggacagactttccatgctcgagacttccatttagtaaaaattcaggcctgttgtggatcttcagatcatttgaaaaacagtcactgagcacttggggtttgctgtatttctttttattaaacctatttttagaaccctcatgctgatctcactcttttttctttttaatggaaatattatatgcaagtacagtgtctgaaaaaaaaagtgactttatgtatagtgaaaagcttcccttcaagttattagaaattttagatcttttgagtcttaataagaatttgattttttacctttttatgactcataagcaaattcaccagataagaaaaattgaatctgaaattagttaaattttactactcttggatattagaattaaggtaatagtagaaggataattgaatttcttagctaaattgagggcttgaaaagtttctgaatttcagtactaccactgactcatgtttgagttattatggattatctaccctttgtttatatgtgtggtctgtagatagcagcagggcctggcttagtgcttggcatgagcagatattcaggacgtatgtttgggaagaatgtatgaatgagagtaggtaagtagcaaagctggtgaataagcagttgaagaagatttttgtgatatcttaccatatttaataaattactttggaagacatttgtgtactgggatctgaagaacatgactgcataatttaatgattttgtaggatttattttattaggtcttttttggtgtcactgcctcagaatgttattgtattattttgatcttcttcacttgtcaggctctcagatttacttttgtcagtcttttacagtttctatacagtcaaggaagctgcactgttacatattctttcaagattaatgttttgggaccacattcttcatagtttcttttctgtcaaaccagtcatctttggtgagaagggtgttcatgtaagcagagaagctggtgttgtattatgcagaatgtcatttcctctcacttattttattttttacccagagcctttatcctctctcagctcctgaactgtggatagagatgcccacaatccagcaaatactttttgccttctggattctttgttcagggtctttgtgctcagtgtagcttccttcctaagtagttaataggtccctcttctgctgatctcttctctccccttcccccaattgccagtggtaagaagtatgaggttccttaacatagcacacttttctgctgttccaggtgcttctcctgctgttcctactcttcttcccctacctctctctgtacctagctcctgtttcagtcaccaaggtttggggtgcaactgattctgtcaacaagtatggagcatagtacccccaaattagtttttcaaccttgtcccttcccaaccttcctcatctagtagtccccaatgtctattgctgccatctttatatctataagtacccaatgtttttttttttttgagtacccaatgtttagctcccacttacaagtgagaacatggagtatttggctttctgttcctatgttaattcgcttaggataatggtttctagctatatccatgttgcttcaaagaacgtgatttcattcttttttatggacacacagtattccatggtatatatgtaccacattttctttatttaattcaccattggtgggcagctaggttgatttgctattgtgaatagggctgcagtgaatctacatatgtacatacattcagtggaaccatttattttctcttggatatatacccagtaatgagattggtgggtcaagtggtagttttaagttctttgagaaatctccaaactgctttccccagtggctgaactaatttacattctcattaacagtgtataagtgttctattttctccatagccttatagccaatgtgtgttgtttttgtctttttaatagtagccattctgactggtgtgagatggtatctcattgtggttttgatgtgcatttctctgataattagtgatgttgagcatttttgcatatgtttgttggccacttgtatgaaagtgaccagttttaaatgaatgtgtcaatataaagttttcctcctggttcacagtgtttttcttaagagtattgcctttttttcttgaaaaagagaataaaacttggtattttttttcccagacaaatcctaaaccttaagtttgggaaagcactgtggtcttctccttacattgtatttctgtattaagacatgaatgtattttgtctataaactgatttatttctctcatctatcaatagctaaacataatttctcttcttttatgtctctctctccccacctttcccccatcatcccttcttctacctcttcccttttctccctacttttctgcttctctcttaccatttttcttctctctttctctctcctggaccctctgattttctcacttgcccttcactaactatgctcaaagaagttaaaaactgaggtcggagatggtttttgtaaagactaataattctgatgcaggactaaattaaaaatagggttcttacatgaggtttgaattagaaagttgtgtggatattgtcatgtaacttcttctagtaacctgttctattgcttacatttaataaataaaagccaagctatgacttaaaaatcttatcccgtaatcaaagtaaagtctgtgctattgttatagtgagtgttatacaaaagcaagtcagtgttagtcatttacttttggaattattatctttcttctaaatgcaagcagtactttttccctcagcagactttaagtgtaaataactagagataatataaaaatattaggaagaagggattgattatctctcatttttgattagtacagatacagaattttatttttcttttttctttctgaattttcttcctcccttctggatttttatcttctttcggctttcttttaaagagaatacttctttgctggaatcaattcagataaaaaggtagtagttttttattggttagggaaatttagtaataaaaaagaagaatgggaaagagagagataagaaaaatgatgaggaatctagtcaattatgaatttaccagtacaggaaaatataatggtaacatggatatcttctgtttcagaagagcaggcaaggattgggggttacatgcctaatagtgattcctgcaagtcaacttttcaaaatagcaacatagtggagaattctgctgaatgatattcttaaaagcataaggccagtatttatcattcagcaccaaataattacagatagctttcttcccagaggaacagaagaagtaatgtgctagtaaatgcactaattctgtatctggcctgctgtctgtcacttcatgatagtagaagagttgtggaggaaagacgttaaatcatttgagatgtttttggtgctatcttgtatctactagtcaaattttacattacacattatgcacttaaagggcataagttttaaagatatttcaatgatgttctgcctagtgtagattttttttctgtattgtgtaagttcctgacttgaggttgtgaaaccttagcttgagggtgacaatgaggtgaagaagagatgtctatgaacctgattttgtgtgtatagtattttgtgtgttctactacagaaggtccataggttttattccaaaacctaataaaaatagaaacctgtgctatgagacccaggtaagaatttggcatggaaatgttagccaggcaaatagagaaaagatacattgttttcatagactcagccacaaaactgtgccttccccctctgatctcagccgcttactgtaaagaatgttacctataagtattgtattttgatttagattcccatgtttttgagtataattgtaaccaattttatggtaattatttttgaaagaaaaacaaaaacatggtctagttatatggcagttatccaaaagtattgtctccaaagctgattccaggataaaaaaattaactattttgaataatagctttaggatcactttgataattagaggtggtaattggccttgttgtattgtatcttttttttttttttttttttttttttttgagacggagtcttgctctgtcgcccaggctggagtgcagtggcacaatctcggctcactgcaagctctgccccccgggttcatgccattctcctgcctcagcctcccgaggagctgggattacaggcgcctgccaccacgcccggctaatattttgtatttttagtagagacagggtttcactgtgttagccaggatggtctcgatctcctgacctcatgatctgcccgcgtcagcctcccaaagtgctgggattacaggcgtgagccaccacgcccagcctgttgtcttgtatcttaacactcatttttaagtcattaattaactaagctacatactttatgtgtatttctccatgtttcagagatactttggcttaataaaaaatatttttaaagagtcttgtggttttcttttttaaaaatcaactaaaatatctgatctattaagcagaatttatcattctgttaacacaatctagtctatcatatttgacagtagtatttctctagtgctttgaataaattaaatcagtcaacaataattgcatttttagtattttaaaattctgttcctttttctcctctacattttttttttttttttgagatggagtctcgctctgttgcccaggctggagtgcagtggcatgatctcagctcactgcaacctccacttaccaggttcaagcaattctcctgcctcatcctcttgagtagctggaattacagatgtgcaccaccatgcccggctaatttttgtatttttagtagagatggggttttgctacgttggccaggcgggtttcgaactcctgacatcaggtgatccacccacctcggcctcccaaagtgctgggattacaggcatgagccatcgtgcccggcctcctctacaattttattttagtattatttattctcaattagtccaggtactgatgcttgtattatgaccattaatatataatcttggcaactcttgtgtttctgttggtaaaacattttcatggattctatcataatgtgatcatttttacctatcgttaagcagtttttcatcattgtatgcttacattaactttccattctgtgttgacaaccttttaatgttaaccaaacaactaaatttactttgatcataaatttaaattgggatgaatgggtagttatagataaaaaataaattaaatgttattatagatagatgtcaataatcaactcttcattttctgattgaattgaaatgtactgctaaggttatagttacgaaaaccaaggaaagtacattggggttttcttggtgccagcatagtgtttgagaagaaagttctaagaatagcaagaggaggagtgatgaatttagcaaatctttcattagtagtaaggtgtgattgcttgaaaagaaaacaatcttttcgagtgagaaataaaaacagtggcaggagtatatatagagaaaaatccaatgcaaaaccgtcctagtgggtgtcaggtaaccctacatgctttagtacaattaaaataggaatgttcaaagtgtaaagaaacagtggaaagagaagtccatctgggaacactgagagggaaagatgcccaaagtttcagctgttttgtggtccttggggccttctggggctactggttttacagttccaagagcatattaagatttttttcagatacaaccaatgttgcagctattaatgagaacaaaccatattaacattattattttgatcctcaaaggaaacaatacaaatgcctcagcaagtgctttctgattgtgtaaaactgaaaataattaactggaaaatgatcaaggagtgattttcaaaaaagatgtgatatatatgttctgtaattggcaaaagcgaaaataatcatattaagttgagaaaaaaagtccttgattaaaagacattcaccacgccatttaaaacattttgcaaaattttagttttatgtatgttatttttaaatcaggttcatataacaaaaagaagcaaatgttttaataatatatttatgtagtatcagaaaggaagaagactcctctcccatttatttttcctgctgactcttgttttaaattctaatttcaacaccctttgccagtttggagaaatgatttgtcagctgctctgtgaagaacactaaaatgcgataggaatattttaaatgcacaagtactgaaaggaaagtgcaggcgtttcccaagactttgaactgatgctatgttgtttcttaacagtgttagatctactaaatatttaaaaggcttttaaaagataaatggctttttttcattcctcatggtgctgatgacttggttgtgtctgatttttaactgatgtcatcagtattgacttgaaacatttcatgggtccttttctcattattcctgacgagtgtactgggcagcttttgttgctgaatgataattttttatctaaggagaataccagcaacaaagggaaattccatgggcgctgaaaatggaacctgctggagtaggttcagtatgtaatttagtaataccttttcttttctttttttttttttttgagacggagtcttgctctgtcacccaggctggagtccagtggcgcaatctcggatcattgcaagctccgcctcccggttcatgccattctcctgcctcagcctcccaagtagctgggacgacaggctcccgccactacgcccggctaatttttttttttttttttttttttttttttttttggatttttagtaaagacggggtttcaccatgttagccaggatggtctcgacctcttgacctcgtgatccgcccgcctcggcctcccaaagtgctgggattataggcgtgagccaccgcgcccagcctagtaatacctttttaaattttatcagtgagctctgctgtagttcctggaaattctggtgtcatattcctttgtgcctgtagctgttcatcttcccttgggccacaagcctgtataataactcatttcactctgatctttggaaacactgtgtgaatctctattttagcatttataatgcatgtcataattatttgtttacatgaaactctcccttgccagaatgtgagctccttaaggatgagaactaagtgcttttttctttgcatctcaccagcactcaacactgggtagaaagaagggagccttggggaggcctcttggatgtgtgtttcgtagttgaaatctctgttaatttgagttagagtaagagtactttgttttgacttgaaagtcctagtgagagtcattccttaatcaaaataactgatacatgtatatatacacacatatatataactcatatatacatgcatttatgtagacctttatttgaaatatatatgaaacataacataagtgaaatatataaatgtatatttgaaattgtaatcataaatatatctgtaataacattcaaattgaagaaagataattggctcaaaaatcagttaaaaatttcttccgagatttctacttttataagtcgtatcttttcatgtatattttactttttctgtacaattaaatgttgttataaataccttcccatcggtatgctatttcacgtatagattgattatctgtggtataaggaatgtcacaaatttcaaaacttacttttttgcctttttgaagtatttgactagggaatccacagacatgactgattaaaagggattatcagctttcacctaattcaactttaagcctttagtctggctttatttaaacaagtcaagataaatgtgttcctggcttttttaatcttaaaataggaaattcatttcctctttagtaatgcattttactatgttttattagttttttttctgttgtggttaaactcattttagaaaacttttaaaattcaggatacccttttctatgaaaacaagcagaattaatttctattattaataatcagcctataaaagttatctatcattttgttatcttaatatttaattataaatatcagtttttaatttacaatggctacattaattagctgggtgcagtggctcatgcctgtaatcccagcactttgggtggccaagccaggaggatagcttgagcctgggaatttgagaccagtctgggcagcatggcaaaatcctgtgtctacataaactacaaaaattagccaggcatggtggtacatgctcgtagtcccaattacttgggaggctgaggcaggaggattgcttcagcctggaaagctgaggctgcagtgatctgtgttcatgccactgcactccagcctgggcgacaaagtctcaaaaaaaataaaaaataaaaataaatcactatgccaatgtgggagttatgatcatctctgtttttaaaaattatctatgcaagcatggggcataacctttgttatagctctttcactgcattttttggctctatttcccaaataaaatagagaaacaatattttaaggaatgtattgtccccttagctttcttattttgccttttcaggaactatttgcgtttgcggtattgcttaactatgaaatgctagaattcataacccactatcttcatttcctccaggctagtagcttaataacatgaagaaaaattgattcttgtagtacctaaaatgacattttctgcctacataacctgttaatccagttttgagttcccattacattttcatcgtcagtggcaagccagattaatttatagtataatcattcaaaaagtttagtttacagattttaaagttgcttttcatatcaattttatttatgctgtttttatatttaaattgctttctatgtgagtcatccatgtaattttcatccaaactgaaattaacctttgcgtaatttctgctttcttgaaactactttttcttttgatgattaaatattgtatgattactggagttggtgattgctaactactgagagtcagtgtctaaagcacagtttctgactggcataaatgaaactactttgcaatagtcaatgtaatttcactgtaagggtcattgtgagcagatggttttccatcctgcaggattttaaatcttgaattctacagagtttgatattttgcacattaccaggagtttaccattaaagtcatggatttcaagtgatccaactcttctagctttaagagaatattaatttatgctgctttatgttccaattcttgaaagaaactggtatttagatgaaattaggtgattgacttttagactgggcaaaattaaactacaaaggatggcttaaaaaactgagaatggagcaagtgaggctccctattcatgctatgagagtctgtttttggactccttagagcaaggtatagtagcgctgaattctttcatgaatgccacctcctttttttctctttcatcctctttttcaaaattgatacataaaattatacatatttatggggcacatgcaaaatttcattacatgcatgaatgtgtaatgatcaagtcagggtgtttggggtatccatcatcttgagtatttatcatttgtatatgttgggaacctttcaagtcctctcttctagttacattgaaatatataacagattgttgctaactatagtcaccctactctacttttgaaaattagaacttgtaccctctaactaactgtatatttgtacccattaaccaacctctcttcatcccccctcccacccacacatccttctcatcctctggtatcttatcactttactctctaccttcatgagataaacttcatgagtaaagttcatgagataaattttttagctcccacatatgattgagaatatgtgatactagtttatctgtgcctggcttatttcacttaacataatgacctcctcttcaatccatgttgctgcaaaagacataatttcattctttgttatagccaaatactattccattgtgtatagccacattttctttatccattcatccattgatggacacttaggttgactccatatctttactcttgtgaatagtgctggaataaacatgagtgcaggtatgtcttcaacatatggatttattttcctttggataaatacccaatagtgggattgctggatcatatgatggttctattttttagatttttaacaaaaatctactattttccatagtggctagaccaatttaccttccatcaacagtgtataagagttcctttttctgtgtatccttgctagcatctgttctttctttgtctttttagtaatagccattctaattggggtaagatgataggtatctcattgtggttttgatttacatttccctgatgattagtgatgttgagcattttttcatatacttgttggtcatttgtatgtcttcttttgagaaatgcctattcagatcctttatccactttttaatgggattatttgtgtttctcaaactattgagttgtttgagttccttgtgtattatcttgcatattagttccttgttgaacgagtggtttgcaaatattttctcccattcatctgctgtctttttactcttgtttttcttgctgggtagaagctttttagtttcatgtagcttaatgtctctattttttgttgttgttatctgtgcttttgaggtcttaggcataaaatccttgcctagactaatgtcctgaagtattttccttatgttttcttctagtaattttatagttttgggtcttgagttgatttttgtatatgtatggtaagagataggggtccagtttcattgttttgtgtatggatatccagttttcccagcaccatttattgaagagggtgtcctttcccaaaagtatgttcttggtgcctttgtcaaaaatcagttggctgtaaatatgtggatttatttttggattatctattttgttccattgatcaatgtgttagtttttataccaataccatgctgttttggtttctatagccttttaatatatttctaagtcaggtagtgtgatacctccagctttgtcgtttttgctcaggattgctttggctacttgggctcttttttggttctatacaaattttaggattgctttttctatttctatgaaaaataacattggccaggcatggtggctcacgcctgtaatcccagcactttgggaagctgaggcaggtggattgcctgaggtcaggagtttgagaccagcctgaccaacatagtgaaactccatctctactaaaaatacaaaaaactagctgggtgtggtgatgggtgcctgtaatcccagctacttgggaggttgaggcaggagaatcacttgaactcaggagatggaggttgcaatgagcctagattgcaccattgcactccagcctgggcaacaagagtgaaactctgtctcaataaaaaagaaaaagaaaaaaacagaaaaataacattagtatttttgtaggcattgcattgaatttatagattgttttgggcattatggtcattttaacaatattaattcttcccatccaagagcataggatatctttccatttgtttatgttctcttgaatttctttcatagttttatagtttttcttacagagatctttcactttcttggttaaatttattcttaggtatttttttgtggctattgtaaatgagattgtcttcttgatttctttttcagctagtttgatatttatgtataaaaatgctactgatttttgcatgttgattttgtatcctgtaactttactgaaattatttatcaggtctaagagtttttttggtggagtctttaagtttttctagatataagattatatcataggcagagaggggcagtttgacttccttttttccaatttggatgtcttttctttgtttctcttgcctgattgctctggctaggatttccagtattgtgttaaatgggagtggtgaagtggacatccttgtcttgttctagttcttagagaaaaggctttctggttttcctcattgagtataatgttagctgtgtgtttgtcatatatgggctttatcatattgagttgtgttcttctatgcctagtttgctgagaatttttgtgatgaagtggtgctgatttttatcagatgcgttttctgcatgtgttgagattatcatgtggtttttgtcctttattctgttgatgtgatgtgtcatgtttattgatttgtatatgttgaactattcttgcatccctgggataaagcccacttgaacatgtatattgtttttttgatgtgctattggatgtgatttgctagtattaagatgaggacttttacctctatgttcattaaagatactgcctgtggttttctttttttgttgagtctttctccggttttggaatcaggataatgctgatcttatggaatgaattagagataattccctctgcttcagttatttggggtagtttgggggaaaattggtgttagttcttctttggaagtttggtagaattcggcattgaagccatttggtcccggacttttctttgttggaaaacttgttactactgactcaatctcattatctgtttttgtctgttcacattttctgtttcttcctcattcaatccaggtaggttgtatgtaccagaaatttattaatttatctcctctaggttttctggtttgttattatatagctgtttatagtagtctctgatgatcttttatatttctgtggtatcagttgtaatgtctcctttttcatttctgattttatttgggtctttgctcttcttttctgtgttagtatagcaagtagcttatcaattttgtttatctttccaaaaacaactaaatttccattttgttgatcttttatatgttttttagtttctgtttaagttctgctctgatttttattattttttcttctcctaattttgcgtttgttttttcctgcttttttagttccttcaggtgtattttcagattatgtatttgaaatctttatactttttaaaaatttttattttattttaaattcagagggtatgtgtgcaggtttcttatgtggatatattgcataacgtttgggtttgggcttctggtatttccatcacccacatagtgaacattgtacccaataggtaatttttaaaccttcacccccttacaccctctctccttttggagtccccactgtctattatttccatctttatgttcgtgcatacccattgtttagctcccacttataagtgaggacatgcaatatttgattttctgttcctgagttattttacttgggataatggccttaagttccattcatattactgcaaaggacatgatttcattcttttttttctttttctttttttttttttttgagatagagtcttgctctgtcaccagactggagtgcagtggcatgatctcggctcactgcaatctccgcctcttgggttcaagtgattcgcctgcctcagcctcctaagtagctgggattataggtgcacgccaccacacccagctaattttttgtatttttagtacagatggggtttcaccatgttggctaggatggtctcgatctcctgacctcatgatccgcccaccccgtgtcccaaagtgctgggattacaggcatgagccactgcgcccggccaatttcattctttttaatggatgcacagtattacatgatgtgtaggtaccacattttctttttccaatcagttgttgatagaccctttggttttttttttttttttcttgagacgatgtctcactctgtcgcccaggctgaagtgcagtggcgcgatcgcagctcactgcaacttccgcctcccaggttcaagcgattctcctgcctcagccttccatgtagctgggactacaggtacgcgccaccacaccaccacacccgttatttatagtctttgtttctttctttttagtagagacaaggtttaaccgtgttagccaggatagtctcgatctcctgacctcgtgatccacccacctcagctcccaaagtgctgggattacaggagtgagccactgtgcccagcctgatagacacttaagttgattcaatcactttgctattgtggatactgctgcaataaacatgagtgcaggtgtcttttttatatgatgataaactctttctacctttttgatgtaggtgtttattgctataatgaacttccctcttagcactgcttttgctgcatcccataggtttgatttgttgtgttttgatttttaattgttttaagaattttttttatttcatccttgaccgagtggtcattcagtagcacgttgtttaatttctatgtgtttgtatggtttcaaaagttcctcttgttattgatttatggttttattttgatgtggtctgagaaaatacttgatatgatttcatttttaaataattagttgagacttgttttgtgtcctaatgtatagtgtattctgctgagtgttccatgtgcttatgagaagaacatttattctgtaactgttggatgaaatgttttgaaatatctgttaggtccatgtggtctaatatgcactttaaatccaatgtttctttgcaaattttctatctagaggctaattctgagagtgggatgttgaagttcctaattattattatactgaagtctttctcactatttaggtctaatagtattttctttatatacctgggtgctccagtgttgggtggaaatatatttagaattgttatattctcttgtggaattgatctctttatcattttataatgatgacctttttttttctttttactgttttgacttaaaatctgttttatctaagtatagctactcctgcttttgcttcttattggcatggaatatattttttccattcctttcctttcagcctgtatgtgtctttacaggaaagatgagttacttataggcagcatatagttgggtcatgttttatttatttatttatttttaattctttgaacctgtctatattttttaagtggaatatttaatccatttacattcaaggttgctattgatatatgaggccttattcctgtcattttattaattgaagtcattgttatttatattctttgtttctttcattctctcttattgtttatctttgtggtttggtggttttctgtagaggtaatatttgagtctttttatttgtgtttgcttcaccagtggtttttatattttcatatgttttcatgagggtagatttcattcttttgcttctagatgtaggactcccttaagcctttattggaggatgggtctagtgatgatgaattttctcagcatttacttatctgggaaatactttagttctctttcatttatgaaggataaattttctgggtatagtatacatggctgtcagttttttttctttcagctcttgtgaatatatcatcctaaactcttttgacctgtaagctttctgtggagaaatctgctgttagtctgatggggattcctttataaatgattagatacttttttcttgctgtttttggaattttctctttgtctttgacttttgacagtttgactataatgtgctgtggagaagtcccttttgagttgtatctgtttggggatctgtgcacctcctgaatctggatgtctaaatctcttgctagggtagagaactttttatctattatttcactaaataggttttctgactctctcattttctcttcatcttctggaacaccaaaaatgcaaatatttggtcactttatggtatcctatgtcatctaggctttgctcattctttgtttttcttttttctttatttttgtctgactaggttatttcattagacctgtcttcaagttctgagattccgtcttctgcttgatttagtttactattgaagcttttgaatatattttgtatttcactggttgaattcttcagctccagaatttctgttttattcttttttatgatatgtttttggtaaatttctcatttatatcccaaatatctggcttatttgtattgtttttcagagttcttctgtatctcactgagtttctttagtatacatattttgaattatttttctgggattttgtaaatttctctttggggttgattgctagagaattactacattcttttggaggtggcatatttccttctttttcatgtttcatgtgtccttatgttgctctctgcacatcttgtgtaacagttgcttctttcaacttttttgagtttgctttataggggagaactttttttttttgaagatgtatcatggtattggttggatagggcacttggctttgattctgggtgtgtgcagtagtacagcttctatgtaatttctttggcgctaaacagcatcagtggtgtctgtgatttctttggtggcttagggtgtgattgttaatggaagctgtggtgaaattttgctggggactgggatgccaggtgggccagttttggggccccagtggtggcagcagtgagctgagtgtgcctgtccttgggccttagggtggtgtatgctggcactggcagtgggtccagaaaggcctattcttgagcctccaggtgacttgcttaggtgccaggaatggcagtgtgggtcaggcaggtaggcaggttctcggtcccctgggcggctggcatggagtgagtgatggcagtatcaatggtgggacaattgtctgggacaaaagtagtctgtgctggtgttggcagtggctgtgacaggctgggtgggcctgtctccagggccttaggagagtgtgtgggtgggtgccagctgtggtggtagcagcaggttgggtgggcctgaccgcaggctctgggaggagtacccgggtgccagtgatggtggacttaactgtttgatcaccaggtccttagatggcacgcttacttactggaggatgaatcttcaggtggggtttgacgcatctgtactacagccctgctactgaggagggcaagatgcctttcagtgggagcaactgtaagcaggcggctgggacgcatgcactttgctcatgctttggccttgcagtagcccatagtggcagtggctgtgggcatttgaatttgtccttggggtgtgtgaaaatgcatgacccttctgctgctggggtgaggttgctgccagtggctcctgcattggccctggcagaggctgctgcaggcagcgaatgtaaatggcactccagggatgtggggatgcaggggctgttgggacccagggaatgatgcagtctgatgggggctgagttctcaaaatggtgctgtgccatgcctgtttaggactcagggtttgtaggactcagtatgagctctctctggagcaatactattgcacagtctccaggcagctctctatgttggtctcagggcctgcaggggtcaagtcttttcctgtgtttctcctatgactaggattgcaggagttcacagtgggaacgtggactgctgggggatctcttacttatcatttccccacattagggagcctctccaggctcccagctgatctcagtcaagcaggctgacttgcttccctttcctttcttgctttaggtgtttctgtcacttccctgttgaatgccagtgttctttcttagaggatctattttaagtgtgattaactacttgctatttgggttcttctttgtggaagagaagagtaccagatgcatctagtcagccatcttgaacttgctaccttctactttcactgacattcaaattataaatctttagagaaataatggagatacttatactttttctttcctaacattgaaatgtgttttgattaaagacaacaatgccttgtatagcagggatatagcttatttatgtttgtcttcttagtgcctgccacagaatggctactcagtaatttagtgaataaaagagtaaatgcattgatggatgaatgaaaatccctcggttatcagtgtggaaatttttaatcattagctatgttatcctgcctgtttggccttttcaggaacctatctctactaggtaagtcctcactagggcattaggctctaaattctaatctctagtgttactgttaccatgattttcagaaaggaattaacttcctcccattttaatgaaacataaaatgctcttgcatatgttttaatagaattaacacagtatgatttctggttgaaataatcttttttcatttttgcttattaataaataatgtatcaatagtgaatgatttatcataagtaaatggtaaaatacaattcacacagattgtcccttgaggtctaatatcttttgtataaaaaaagtttttaaaaataaatattttgtgatggtcataggcttctgaagttattagaaagggatatatggattataggaaatattttcctgataatatggtagaataaaatttttctagtttttatggtgattctttactttccttttagacaattccgtgtgtgtatgtgtgtgtgtgtgttgtgtgtgtgtgttatacttgcatctgtttcttcatctgtgcccaaaaagtgggttctcaaattttcagttagctttctattcttatctctctgtagacagcttctcctttggaaaatagcatctattttcagggattcaaatattacttctttcaagttaattcaataatatttctctttagttttaatccacaactgagctccaattctaatatcatcaaattatgtaatgtacatttccacctggaggtctcccagacagtccaggttcagcatgtctgaaatcaatttttttcacttttatcattctccctagcttcagagacttgggctcaccttccatcccactctctgtatctccctccctgcagttttttcttttcttttcctgggaggtagcttttgtatcatttcccttctcattgttcctctcccaattcagccatttatcctattgtcccataatagatttccttatagctacttaacttttcttctagtctactcccacctccctgaacaaatataaactggatacaactgtttacttcagcatattgctttcctctaaataacttcccatgccttatatactctgtagttaatatctaaactcattagcctggaattcaaaatctgaattttgccccactctgcatttctggttttggttccagtccttcagcttctgaaatctacctcagcaggtcagcacatgtactctttaacatgtcttgattttctgttttttttctcatgtcccttttttatctcagttttcttttcatgaatctatcccatttcaggaagctaggtttttgttgttttggactcttctcagaattcctgtagcacttatataagccatttatttaatagttaattgttgacagtgtgacattttctatatttttgtcctatgttatttatttcaagttttctcatttttttcacatgattatatgcttcttcacaaactaactgtgaagtcctaaaatagtctttaagatcagagactatatataatatctttaaatattttttttgttttttttgagacggagttttgcttttgttgctcaggctggagtgcaatggcagggtcttggctcactgcaacctctgcctcctgggttcaaatgattctcctgcctcagctttccaagtagctggaattacaggcgcccaccaccatgcccagctaatttttgtgcttttttttttagtagagacagggtttcactatgttggccagcctggttgcgaactcctgacctcaggtgatccacccacctcggcctccaaagtgctgggattacaggcgtgagccaccgcacacggcctaaaatgtttttataatactgaagtaaaacctcaaaagacccataatttcttaattataattaagcttttattgagttatatcttttgtaatactttctatgtataaaatattatttcaaaaaacattgaaaactttacgaagactctcctgtgtgccaagaacaagtcttaggagctgctaactctgttcatctcaccccagtatagtactgtataaagcgtaataattggtaacattagttgataaagcaaaaaaattaactcatcagtcaaaagaaatatccaattaaagttgagtgggccctatttgtacatgttttagtgactgtactcatagtaatctataaaaataattccaggagtctccttcagagaggacattaatctattaagatattaagcttatacaatagatgattcataatctctaaatatgaaaataatgtaaacattttcaaaaaggagtaaaatgacatagaggaagttatacttgtaaaattatgagtgagtaagtgacctacaaacacataaatattttagcattaaatgactgaattaatgaatgaattagagaataaatgaaccaccatagagatattattgtcaattcaaagataccttctaagttgttgcagcattggaaggagaaatctagaaagagaaaataatggatgtcttttaaaaaatcaagacttttttttagagcagttttaagtttgcttaaacacttctgcttaatttttaaagaaaaatggagcagaaaacccagttttcatatttccccttacatacccctacacagaggtttccatgttattagcaccttgcattattgtagtacatttgttacaatattgaaccaatattgatgcattattattattaactaaagtccacagtttacattagggctccttccttgtgttgtacagttctatgggctttgccaaatacataatgttatgtatccactacagtattatacaggatagtttcactgccctaaaaaactcctttgcttcacctacttatctttcccccttgccttttaccaggtggattcacagctgaattctatcaaacattcaaagaagaattgataccaatcctattgacactattccacaagatagagaaagagggaatcctccctaaatcattctgtaaagccagtgtctccctaatacaaaaccaggaaaggacataacaaaaaaaggaaaactatggcccaatgtccctgatgaacatagatggaaaaatcctcaatgaaatactagctaaccaacttcaacagcatatcagaaagataatccaccatgattaagtgggtttcataccagggatgcagggatggtttaacatacacaagtcaataaatgtgatacaccgcataaacaggattaagaacaaaaatcccttgatcatctcaatagaagcagaaaaagcacttgacaaaatccagtatccctttatgacaaaaacctcagcaaaattggcatagaagagacatacataccttaactggaacatgacaggggaaacaaaagctctggttttcattgagtatttaaataattaaactttttctccaataaaaacttatcaattatacttttttttgggggggggcggtggacagagtttcactcttgttgcccagggtggagtgcaatggtgcgatcttggctcactgcaacctccgcctactgtgttcaagcgattcttctgcctcagcctcctgagtagctgggattacaggcatgtgccaccacgccaagctaattttgtatttttagtagagatggggtttctccatgttggtcaggctggtcttgaactcccaacctcaggtgatccgcctgcctcagcctcccaaagtgctgggattacaggtgtgagccactgcacctggccaattatacttcttttaaaaaattttctgatgcccagcgttggccatatacataaataacactatattgctttataagtagtgcaggtattcccaattcctgcctcccatcctttataatatttttgttattcattttacttatccataagctatagtcattgaatacattgttcctattattattttgaatacattgttgtctgtaacattcatcttttctttatataatccaagtttctaacctaagccattatcctctcttcttaagaggttcttaagaacctctgttaactttttttatccccccaagacagagtctcgctctgtcgcccaggctggagtgctgtggtgcaatcacggctcactgcaatctccacttcccaagttcaagcaattctcctgcctcagcctcctgaatagctgggattacaggcgcatgccaccatgcccagctaatttttgtatttttagtagagatggggtttcaccattttggccagactggtctcgaactcctgatctcatgatccacctaccttggcctcccaaagtgccgggattgcaggtgtgagccaccacacccggccaacacttctttcaagataaatttcctcatttatcagttctaggagctttttggaggagtctttagggttttcttggtatacaatcatatcatcagcaaacagcgacagtttgactaactctttaatgatttagatcccctttatttctttctgttgtctgatagctctggctaggacttccagtactatgttgaatataggtgatgagagtgggcatccttgtcttgttccagttctcaggggaaatgctttcaagttttccccattcagtataatgttggctgtgggtttgtcataggtagcttttattatgttaaggtatgtttcttctatgtcgattttgttgagggttttcatcataaagggatgctggattttgtcaggtgctttttctgcttctattgagatgatcatgggatttttgtttttaattctttttacatggtgtatcacatttattgagttgcatatgttaaaccatccctgcatccctggtatgaaacccacttaatcatggtggattatctttctgatatgctgttgaagttggttagctagtatttcgttgaggatttttgcatctatgttcattagggatattgggccttagttttcctttttttattatgtgcttttctggttttggtattagggagatactggcttcatagaatgatttagggaggattccctctttatcttgtgaagtagtgtcaataggattggtatcaattcttctttgaatgtttgatagaattcagctgtgaatccatcttgtcttgggctttttttgttggcaattttttaaaattaccatttcagtctcgctgcttattattggtctgttcagagtttctatttcttcctggtttaatccaggagtgttgtatatggccaggaatttgtccatcttttctaggttttctagtttatgcacataaaggtgttcatagtagccttgaatgactttttttgtatttctgtggtatcagttgtaatatctcccatttcatctctaattgagcttatttggatcttctctcttcttggttagtctcactaacgttattaagtttgttaattaattttcgaataaccagctttttgttttatttatcttttgtattactatttttgtttcaatttcatttacttctgctctgatatttgttatttcttttcttcttctggatttggatttggtttgttcttgtttctctagttccttgaggtatgaccttagattgactatttgtgctttctcagacttttagatgtgggctttagatggactttcctcctagtgccatttttgctgtatcccagaatgtgataggctgtgtcactattgttgttcagttcaaagaattttaaaagtttcatctgaattttattgattgttgactcaacaatcattcaggagcaggttatttaacttccatgcatttacatggttttgagtgttctttttggagttgatttccaactttattccactgtggtctgagagagttcttgatataatttcaattttctttattgagactcgttttgtgggctatcatgttgtctatcttggagaatgttccatgtgctgatgaatagaatgtatattctgcagttgttgggtagaatgttcagtaaatatctgttaagtccatttgttctaaggtatagattaaatccattgtttctttgttgactttctgtcttgatgacctgtctagtgctgtcagtagagtattaaagtcccacagtattattgtgttgctgtctatctcatttcttaggtctaatagtaattgttttataaattcgggagctgccgtgttaggtgtatatatatttaggattgtgatattttcctattggacaagttcttttatcattatataattttcctctttgtctttttaaactgctgttgctttgaagtatgctttgcctgatataggaataggtactcctgcttgcttttggtgtccatttgcatggaatatctttttccacccttttaccttaagtttatgtgagtcctttttgttaggtgagcctctgaaagacagcagatagttagttggtgagttcttatccattctgccattccgtacctttttttttttttttttttgagatggagtcttgctctgttgcccaggctggaatgcagtggcatgatctcggctcactgcaacttccacctcctgggtttaagcaattctcctgcctcagcctcctgagtaggttggataacaggtgcctgccaccacaccctgctaatttttgtatttttagtagagacggggttttgccatgttggccaggcaggtcttaaactcctgacctcaagtgatccacctgcctcggcctcccaaaatgctgggattataggcatgagccactgcacccagccagcattctgtatcttttatgtggattattttaggacattttcattcaacattagtattgagatgtgaggtactattctatatattatgcgattttttgcctgaataccttggtttttttcattgtgttttcgtcttataggtcctttgagatttatgctttaaggaggttctattttggtgtattttgaggatttgtttcaagatttggagctccttttagcagtgctggtttggtagtggtgaattctttcagcatttgtttgtgtgaaaaagactatctttccttcatttatgaagcttagtttcactggatagaaaattctttgctgatactgatttagtttaaggagactaaagataggaccccaatcacttctagcttgtagggtttctggtgggaaatctgctgttaatctggtaggttttcttttatagttacctgatgcttttgccttacagctcttaagattctttccttcatctttagataacctgatgactgtgtttctaggtgatgatctttttgcgataaattttccagattttctttgagcttcttgtatttggatgtccagatctctagcaaggccagggaaattttcctcgattatcccctcaaatatgttttccaaacttttagatttcttttcttccttgggaccaccaattattcttaggtttggtcattcaacttcttaaagtctttgttcatttttcttttcgtctttgttagattgaattaattcgaaagccctctctttgatctctgaagttctttcttctacttttttgatgttattgatgagactttctggtgtgttttgcatttctctaagtgtgtccttcatttcgagaagttgtgattattttttatttatgctatctattgcagtgaagatttttcacttcagatcttgtattatttttaaaattaaatttatttggacttcacctttctctggtttccctgattcacttagtataatcgaccttctgaattctttttctggcaattcagagatttttatcttggtttggatctattgctggtgagctagtgtggtcttttgggagtgttaaagaaccttgttttgtcatattaccagaattgtttttctagttccttctcatttgggtagactatgctagagggaagatctagggctcaagggctgctgttcagattctgctgtcccacagggtgctcccttgatgtggtgctttccctcttcccctaaggatgtggcttcctgagagccaaactgcagtgattgttatttctcttctggatctagccacccaagagagctacgaggctctgggctggtactggggagtgtctgcacagtgtcctgtgatatgtgaaccattttcaggtttctcaaccatggataccagcacctgctatgattgaggttccaagggattgaagtggactctgtgagggtccttggttgtgtttttgtgaagtgtactggttttgtgttggtttgcctccagtcaggaggtggtgctctcaagagtgtatcagctagggttgtatagggaggatacaagcttgccctagggttgccgttggataagtattcaggtttctcaggtggtgggcagagccctagagttcccaagggattatgtcctttgtctttggctaccagggctggtagacaaagatcatcaggttgggggaggattagacatgtctgatctcagactcttcttgggcgggtcttgctgtggctgctgtgggggatgaggatttggttctcaggctaatggagttatgttcctagggggattatggcttcctctgctgtaacatgcatgtttccagggaagtcagggaaagctagcagttataggcctcacccagctcccatacagcccaaaaggctggtctcactcccaccatgcccctccaacagcactgagtttatttccaggtagcaggtgaacagggctaagaacttgccccaggcctcccggctgagaaagcaagtggggctttcaagtttcatgcctccccacctgccatggcttctgtgctgtgtctatacacgtgatttgcccccttcccaaggttttgtccaggaagctttgtgtgcagttgaaattgttacaaagtttagctggaagtttccttcttcctatggtcttttcccagttcctttggcagcccttcccatggacccctgtgagacaaagtcagaaatggcttccctggggaccaagagtgcccacaggactctttctgctgcttcttctaccgttgtatttcactcagttctctaaatttgtctcagctccaggtaaggtcaaatccttttcctgtgatctggaacttcaagttcctcagtgagagtgtgtgttccagggcagatgattcccctttcacactttcacactctgggcactagcagtttttcagctgtctcttggggcctgcaacagcaatcttccttcttcaaagggtctctggattctcttggttttcctggtatgttcctgccatagttcttggaggaaaagttcataatgtgaatctccacatgctgctctgtccatctgagtgggagctgcaaggtagtcctgcctcctatctgtcattttttcccacatcttagcctacattttcttctactgctcttgtttatgtttcccctcttgtctttgggtttccctaaagactccttcttaaataggacctatgacttgcagttctttcagctgtaatccactgttattattcaggaacctaattgctgtgctaatgaagtgtggagggagggaaagtgttctgtgttcctatgattaggttttattttgtgctaatgaagtgtggagggagggaaagtgttctgtgatcctatgattaggttttattttgtatatgagtcggtttccccagtctgtaaccttcacaagtgcttctactccattgcccctcatgtgagacaggaagtctagaggtgtttgaagttaggcattcctcttcaccagtgtcaaagacacagggtgctagagttggatattttcctgcccccaagtgagttaggctctcataaatcacagatgagataatctctggcaaagtagtttctttttaatttgatttttattattaatatctgctgggaaaccgatcacaacttgttcaaattgttcctaaaatcagagcaagcagatattgggtgacagcttcaaaaactgtcttctgaattatgaatgtaaacttaataacataaactttgagacatttattaattatctttcagggttttggcatttggtggatgagattgccaacctaatgtcttataggcaaatgaggtttaatcttgttgtcctaatttttcatgcattacttattaaaattaagctccaaacaaatataaatatagttcagcattagtagggaatccagcgatatgtctcctgtaaatgttactaacggttgttagctgtatttgtaagtttacattgatcttggacttcccaatgccattacctaaaatgtagaatccagaatgaatctaacttgaacctatttttcttcctggtttattagagatgtttatctgagagattactatgaatcataggattgtgagattgcctgtggtgacagaaggcatttttccaaatgtagagcttctgcaagtcttcaaaataattaaaattcataaaacacatgtaacagatggcataagtgtttgaactaaatgtgtgtgactttttactacttagttttacataataatgtgtttgtgcagttaaggtggtgacctctcatgataacttctacagatacataaagtgaaatgtgctctctggagttgctaaaatgtgacaattttagaatagatatgaaagtacttttctaatgatttttctataagttcaccattgtaatatcaaattacaaactcctgtcatttggagtttcttttctttgatatttagtcctttccttcaccaaaatggcttgagagaattaactggcagttagtgctgtgttctatagcattcagtttttcctgttaaaccttaaaagccatgtgtatttgaaacttttaattatgttttaaatatctctttgaatataagaagaaatgttatgctcttcatttttatcttggttttgaggagctaaaatcagttcttatccatcaactatcccctttacctcaaaataatacaaccataattctgacttgattatctgtgggtaatggtagatttgtgttaactcatctgtttcgattatatattgctgtgtgagaaaccattcccaaatttaggagcttaaatcaataaccattcctgttgaaacaaagatcaaatccttaagaattagtttagtgagaaatatgcaaaacctgtactaggaaaaagtttaaatactccagaaacacataagtagagttgaaaaatagagacttcccctctttgtatacaaacactcaacattattaagatgttagttctccttactacattagtgtacaaacttaatgcaataccaacaaatgtcccaagaaactattttatggaattagatcctatatttgttgatcatgtatttgtattgttacaaacatgtaacaaaagttaggaaaaggccaaaaaagagaaaactacaagtgatggctagccctatcagacattaaaacctagtaaaataggagatatcttctttttttttttttttttgagaaggagttttgcttttgttgcccaggcttttgttgcccaggctggagtgcaatggcactatctcggctcactgctacctccacctcctgggttcaagcaattctcctgcctcagcctcccaagtagctgggattacaggtatgcaccaccacgcctggctaattttgtatttttagtagagacggggtttcttcttattggtcaggctggtctcgaacctccaacctcaggtgatctgcccgcctcggcctcccaaagtgctgggattgcaggtgtgagccaccacgtcaagccgagatttcttctataactaaaacaccgttatactcatgcttgtatcgaccaatgaccagtgaaataggatagaatgtccagaaataaattcaactacatctggaaatttagcatgtgataaatatagcatctcaaatgactgggctaaagacagacattttagtaaatggttctggaagaactagatcaccatttggaaaaagatattttataccatgtcttatattacacccaaaaataatgcactagggatctaaatgtaaaaaataaaaccatacaagcactagaagaaaataaaagtgcatttttctttaaattttgtatagggaaaggctttttaactctgacttaaaatcagaggcaataaaagagaagattgataaatttaacacataaaacattaaaaaaattttatgctcaaactactataaatgaagtcaaaagacaactgacaaagtgcaaggaaatattcacaacatctagggaaaaggctgatatctctaatacataaaggaaaaaggctgatatccctaatacataaaaaactcttaaaaatgaagaggcaaaagatcaaaaagtctaaagaaatcttctcaccacaaagaaatgataaatgcatgaggtgatggataaagtagctactctgattggatcattatactacatagatatgtattgaaatatcaaattttaacccataatcatgtacaatcataatgtaccaattaaaaaataataatttttaaaaatgaggaacatatctatgaatttatttggagtaatttctagaatattctgttatgaaaaaatagcaaagtgcaaaagaatgtctccagggcacttctttcatatgagaaagaaggagatattagaaagtacttttgtgttctgctcatttgtgagaaaaacatatacaggagttaataggtaagactctgaagaaattagttatgtacatggattgagtagaaatgggttggaataaaggagaataacagcagagtagtatggatgaggaaggcataccttttttgtacggctttgactcttagaatcatagtaatattttacacagaaaacaaagtaaataattgaaatcagccaagtcagctttttttttttttttttttttttgaccgtagtgaggagtcatctagaggtttgacttggatgtagagaaagtttggtctctcttccttgtcatgtagtctcacggccttttcagtaacttccccctttatctctgcagcaagatatcctgtacttcttacacgatggttccaaactccaagagtataagagcaaaagctaccaagcattcctaatgtctaggctcagaaatcccagaacatcatttcctccatattctattgtcaaagcagtcataggctagcaaaaaaccaaaggtgtggaggatgacttttacctctgggtgagagaatggtttgtgcatacaggagggaaggaattgatagtgactatctttggagtttagagatcattgactgatatcagactatgtctcatgatgtagcctgactgtagaagagggaagagccaaatgactcacaaaggagcatagtctcttgtgggatgtcatatttacttttttgaaaataactgagcagtcattagattatcaactgaaatctttctgattgtaagaagatatgttactatttctgagattttctttgtaactgaaagtagatagctagtattgcaactacatagtgtaacataataaatctttttacatggtaggtcatcataatgttgattattcttgtgcccttgctaagttttctatttttaatcttcatacttttcaactattcttcattttcattgttagcagataaatgtactattctgtctatctactgtggccattctccaatttgccattgattgattcactcatttatttacttaacaaacaaatatttgtttgattacattagaaacacaaagatgagtaagaaatcatttttgcatcaagattagtctaacaaaggggaaagactaattaaaacacaatagacatatgacacaaatatgttggaaataggcttgtttggggacgttttaccaaagatatgatatttgtgccagaatttgaaggatttattgttcttcaagtggtggaagtacagtagagcattttaaaaagactcagtagcccaggccttggctcaaaggtctgagagtatgtctgacaagatgggatgctcagactagatagtgtgtctagaatattagtgtaaaattagaaattgttttacattttaaaaaattgtagtaaatataaataagatataattttccattttagccattttaaagtgtataattcagtgaaattaactccatttacattgttgcataaccatcaccactttccatctccagaacttaccatcccaaaccaaaacgctgtacccattaaacaataactttctattaccccttcctcaacctctggcaaccaccattctgctttctatctctatggatcaaattagaaattgaaaatttctgttctctagactgttattgggtattacacagtaggtaagtagcagtcctagcgagggagaaaaaaaaaaggatggagagtttgttgcttattatagctgaatttctactgcttggatggaaacatatgacccccacaggtttaatgcagagagtgtgttttagaagataaacttctagttcattatgtaaatattttttgatacattccaggttaattcttgcttgatattctatggtgagtgcattgagatattactcccaaactggccacttggttaaactagaatagtatattatttagtggtataataaagagtataattgctgagattttcatctgtttttattcttttgttgcagttttcttttttaaaaacttatacgaattttttaaattgcctgaggtgttgttcaggcatttagattatctttcttttcagtctaagagtaattatgaagcaataaaactgccagagaaaagtaaaagttgaagtaattaatattttattattttcttttatcttatttttctgtttatgttagtttgaaatcattgatttatatatgagtgtagtgatcagtagtagaataaaagtgccactttgtttaattcttacaatatcttaaaagaatgttaatagtaaattgctcaaatattagacattgtgcaaagaaattacaatacaaatcaagtgtcttgtgtttcatattttaaagttattttttataaatatgtattataaagtagactagtaatttagtaaggatatatgtgttaatcatactttgacttggaagaaacatgtattcactatctgaaaatttatacagaaagattgcttatctttctatttcttttctgtagtttcagttaattaattttgttagtaaggttgttattctgtcattacattttttttttttttttagacagggtctctctctctgttgcccaggctggagtgcagtggtggtgatcttggctcagtgcagccctgacttcctgggctcaagtgatccatccacctcagcctcccaaatagatgagactacaggtgcacgccaccacacctggctaattttttattttttgttgaaatgggatctcattatgttgcccaggctggtctcaaactcctgggctcaagcattccttccgccttggcctcccaaagcactgtaattataggtgtgagccactgtgcctggccctctgtcatttcttgactatattatcctcacaatagagtgacgaaaatgatggggaaccatcattttgctaagcactgattattttttttgcttcagatttaaaaaaatcaagatacagttcacgtaccataaaacttacctctttaaagtatatattttgctggcttttagtgtatttataaatttgtgaagccatcaccactatctaattccggatctttttttttttccccagaaggaaatcctccacccctcaactttgtcacatcccatttcccctcctccagctcgtagcagtcactaatttacttttcatctctataaattggcctcttctggacatttcagataaatataatggaaatatataatctgtgacctttcgtgtctggcttcttttacctagcataatgctttgaagagtcatcaacattgtagcatgcatcagtacttcattctttttgatggccaaatactattctattatatggctataccaaaatttgtttatacattcatcagttgatagaaatttgagttgtttctattttctggctattgtgaataattcttctgtgaatatttgtttgcaagattttgtgtggatatcttttcagttctcttggttagatacccaggagtggaattgctgtcatgtgctaactctatgtttaaccttttgaagaactaccaaactttttcccacagaggctacaccattttacattcctaccagccatgtatgagggttccaatttcttttcattcctgctaacacttataattttccattaaaggaaaaacctatagccatcctagtgaagtagtattacactgtgtattttatttttattttccaaatgactaaggatgaagagcatcttttcatgtgcttactgatcagttgtctttggagaaatgtctattcaaattctttacccattttttgttgatttatttagtcttttttattattgagttgttaggttttttcatattataatactagacctttatcaggtatatgatttgtaaatatttttttccatcctttgggttgtcttttcactttcttgatagtgtcctttgaagcacagaacttattagttttgatgaagtccaatttatctatttttaagtgtggttgcctgtacctttgttgtatataagaaactattgcctaattcagggttatgaatatttacccttatgttttcttcttagagttatatagcatataaatgtagtgttttagctcttatatttaggtctttggtctgtcttgagttaaattttatatgtgatgaaggtccacaaatgttagtttttaaaaatactcttaagtgtgagatgaaaaagcacttacagtttgggagctttttttctcccgggtcactttctcctgtttctttagcttcaatagaaagactctggactcagtgcttgcactgccttttgcctggactgctcttttccaggccttttgcttgactggctccttctcatcattcacactgcagagtgttcttctctaacttttctagctagatcagctaaccctttcataccccaccgagtttaattcttcacaactaaatatatctagttaattttaactttaagttcagtggtgtgagtgcagtttgttgtctgtatgacaaacccccatgacacaagtttacctatgtaacctatttgttacataggtaaacttgtgtcatgggggtttgtcatacagattatttcatcacccgggtattaagcctaggcttaataaaattggttatttttcctgatcctctccctccttccactctcctccttctgataggccccagtgtgtgttgttcccctctatgggtccatatgttctcatcatttagctctcacttataagtgagaacatgctgtatttggttttctgttcctgtgttagtttgctaaggataatggcctttagctccatctatgtccttgtaaagcatgtgatcatgttgtttattgtagctgcatagtattccatggcatatatatactacattttctttatctagtctatcactgatggcatttaggttgattccatgtctttgctattatgaatagtgttgcaataaacagacacgtgcatgtgtctttataatagaaagatttatatatttttggggtatatacccagtactgggattgctgggttgaatggtagttctgtctttaggtcttggagcaatcacaaccacagtggttgaagtaattaatactcccatcctggacgtataaattatacagtgtataagcattcctttttctctacaaccacactagcatctgttattttgtgactttttaataatagtcattctgactggtgtggtatagtatctcattgtggttttgatttgcatttctctagtgatcagtgatgtggagcttttttcatatgattgttggctgcatatatgtcttcttctgaaaagtcctgttcatttcctttgccctctttgtaatggggttgtttactttttccttgtaaatttgtttaagttccttagagatgctggatattagacctttgtcagatgcatagtttgcaaaaattttctttcattctctaggttgtctgtttacttttttgatagtttcctttgctgtgcaggagttctttagtttaattagatctcatttgtcaatttttacttttgttacaatttggcatcttcgtcatgaaatctttgcttgtgcctgtgtcctgaattgtattgcatatgttttcttccagggttttgtagttttgggctttgcatttaagtctttaatccatcttgagttgaatttgtatgtggtgtaagtaaggggtctagtttcaatcttctgcatatggctagccagttatcccagcaccatttattgaatagggaattctttccccattgcttgtttttgtcagggttgaagatcaggtaactgtaggtgtgtggtcttatttctggtttctctattctgttgcattggtcaatgtgtctgtttttgtgccagtaccatgctgttttggttattgtagccctgtagtatagtttgaagtcaggtagtgtcatgccctcggctttgttctttttgcttaggattgcgtaggctatttggtttttttttttggttccatatgaattttaaaatagttttttttctagttctgtgaagaatgtccatggtagtttaataggaatagcattgaatctacaaattgctttgggcagtagggccattttcacgatattgattcttcctatccatgagcatggaatatttttctatttgtgttctctttgatttctttgagcagtggtttgtagttctccttgtagagatatttcaccttcctagttagctgtactcctaggtattttatactttttgcagcaattgtggataggattgcattcttgatttggctctcagcttgactgttgttggtgtataggaatgctagtgattgttgcacactgattttgtgtcctgagatttgctgaagttgtttataagcttaagaagcttttgggctgatactatgggttttcctagaatatatctagttaatttgtttacttgttgactattcattgcatttcactaggatataagcttcatgaatatagacatcttgtatatctataccccatacctagaactgtagggtgcctgaaacatagtagatgtgcctgaaactgtgtgtgtagatgctcaataatgatttgttgaatcaattcaatgcattgtagtacagggaagaatctagcatttaccccctttttatgagggagacctcttgaaatcataactttagtatctagaaatcagaaaaccatcaattaaagtagctatgctaatctggaaaagaagtgcttcattttcttaaagtttttatatgttctgacgcactctcagatattaaaatgcccttctttcatgttccttggaaggactatctacacctagggagagctacgtttctcctcagtgtgttcttggaaatcataaaggcaaacttaatcccaaatgttgtgcatttgctctaagatctaacattaatttaattatggatatgaccaacaattaattcaaggagtatttattgaaagttcattgtgtgtaatacactgctggatgctgaggatggaaaaataggtaatatgccattaaagcagagttataactatacatttcattaatctttaagatagtaaaaatataaaatataaagtaaaataatataaaatgcaaaggtctgtagtagagtaattcagaggatcaaatttaaggtcagaattactgaatgcaaatttcaactcagctacttgctagctttaagggcttagatgagctaatctttttaactttcagtcacctcctttgtaaatgataacaataatattacctgccacacagggcttttatgaagattaaatgagaaaatgtataaaaaccacttagcatacacatagtaagtgtgcaaaatactacattatataaatattagagtttcaaatctgcaggtattttttttgaaacttttaaaaacttccttacttagctggcttgctttcagagtgtatcccaatttactggcaagcctagtacataggcatgtgctatcttcttaccagcctttcttccccaggtgtatagctctatccctggcctttttgatgcccaacccagctagcttctgacagatgttttcaatactgactgctttcctgaatttccatagtgtgtatttataatacacatatacctaggttctatagagaataaaatgtgccttgaaggcattccctagtgaacacaaataaaattagttgttaccagattaacacaacttctatctttgcctatcatatcaatgtttttgccatttacttggtggttaaggaatgtggtacttctcaaaagaagacatacatgtggccaaaaaaatagatgaaaaaatgctcaacatcactaataattagagaaatgcaaatcaaaaccacattgatataccatctcacaccagtcagaatggctattattaaaaagaaaaaaacagatattggcaaaaatgcagagaagagggaacacttatatactgttgatgagaatgtaaatttgttcagccattgtggagagcggtttggtgatttctcaaagaacttagaactaccttttgacccagcaatcccattactgggtatatacccaaacgaaactaaatcattctgccaaaaaaagacattcactcatatgttcattgcagcactattacaatagcaaagacatggaatcaacctagatgcccatcaacagtggactggataaagaaaatatgttacatatacaccttggaatgctacgcagctatagaaaagaacaagatcatgtcctttggagccacatggatgcagctagaagccattttcctgagtgaactaacacagaaatagaaaacaaaataccacatgttctaatttataagtaggtgctaaacattatgtacacatggacataaagataggagcagtagacacagggcactggggactatttgagggcggagatgggaagggaggcaagcattgaaaaactaccggaagggtactgtgtttaccacctgggtgacagggtcattcttatactaagcctcagcagcgtacaatttacccatgtaacaaacctgcgcgtgtaccccgaacctaaactaaaagttgagaaagaatgcaaaagtttaaaaaaggaaaaaaaaaaaaaaaaaagaaatgtggtagatgtgttcatactttttagttgactattccagacctgaaagaatacaatgtaaattgaccataaaaaatagaaaattttgagaaagagacagattttgtgacattggtgtaaatgacattggagaatctattgaatcccagtaaaaccactgatacgtgaggatttgacagtttacaattgaagcagaaaaattatcaagggtaataatataatgatgcttcaaaaggaactgattggaagaacaaaggattaagagaaactatttggaaaccagataaacccttgaatatacctgttagaagatatctgttacagtcttctaggtgttaaatgtgaattgacagatactatatcagactatcatgaagtaatttcagaaaaatcaacaaaggacatataactggtttattctttgatctaaaagttagtccagagttataattacaactaaaattttgttaaatatgacataaagcagcttacttttatatttctccaagttccttttcaagatgaaatcgttaataagtggatcaagttaactttgtaaggaccaattagtcttagccaaagtagtatctctgtactactggttccttatttgcctgtgctcagcctatctgttgggatacttcacttaggattgctttgaatctgaggtctgtattaagcccaatgtctattaactatttttttgtatcccatgatccactggtctgtactaagctggactttaactggtctgtactcaaattgtgatattaatacaaaggattgaggaggttcagattcagactttgatactcagcacaaaggtaagatggaagtaatgagattcaagtgactgaatttggtagttcatcctatagaatatgattgaaaggtagagtaaaaccagattatgaaaaactttgtcaatctaaagggtatatgctttaacctacaggttagagtttctcaaattgtggtccacagaccacttgcgttgaaatcacttgtgatatatgttaaaaattcaaatttctgatccccatctatgaatcagaattctggggctaaatcctaggaatatccagttttgagatatctttatgtacctcttacgtacattatagttttagagttattgttaaacctaagtagtttgataaattttcccctgcattttattttttaagtgttgatgatggtgtaacttttgtcacaaaaaaacttagaagcgatgccatatttacctggaattttagcttcattaattgtttctttagataatattccaaagcttattctaaagataaatatgttttatatgataattctgtatatgaaatagtttaaagagagcattagcacttaattccatgctttcaggattttcttataaaaacaaattttctttgaaagtgatatctaaattttttcagtttccccacatggaaactcctgctgttatgcaacactgaaataacaacattgttttcacccattaagataccgctgcaagatattgtgaattggctcatttgccttaaattttttttaacaaataaggcagtgttttgagttatgccagatgtacaaatgagagatttgagtgtacttgtagaatttaaattggaatgctaatgagattctgacaggcagaaaaaacaacacagcctacattttcatctgttttattaaagtcattatttaactggaaaaacacattatttagagctatttatttatgtggcatttgtaattcagctcttaaattttatccaattaaagtgcttctcattctatttcacttaatgcagtagattgttttgtgcattcatctttttctctgtttcattcagtggtagagtggcagtaactcaattgaatgaatgaatgtgccttttttttaactaatgcttacatgtgctgcttcatgctgtgatgctacattgacatctttattttttgtttgcagtaattccattgaaatttaatggtacattattatacaagattgcttatggttatttcatgctttggttactttactaaaattcccaatatgtgaaagaaaaacataatgttaaaaaaactccacatttctgagaagataaattgatcttagagataattgaacataagacaccaagccttaaaagtacttatttcaacaaagatatacaatgccataccaaaaatattgctttttcaaaagacttttatttattatttatttgcatttttccatttgtatagttattttaaagaaaggctttttgtgaatgtttgagattgcttaattacagcagctttttggtttcctttatttatatttatctatctacctctcagatgaggtttaaattagagtttttaaggttataggggtttaaaattttatgtacatgtacaaaatctgtactagaggaagaaatactagtgcataatttcaagggatagcgtgaggctggctgaggtcagacccatgatggaatgcagaaattatgagagggtatagaagacaatgtgtttccttgaaaaggcaacttctgtgaagagagtgaaatatgtgagtccagaattgtacagatgtcatcatgaatgtcagatctctcaactgtattctatagtgggtttaggattcttatattgtaagaaggctttatatattttaaacagcctgatggtattcttatgaaaatctaaggtaaaagaagctcattggcatagaaactatttcagttaatgttcaatgaataaaatctctatattaactggaaattgaacatgtgactgttggtttcctgacatttacataaagcttcactcaagagggcgccattaagcagcattaaggaatttcatacacaactgtatatctctaaaacttccataagaggtaggctcttgaggtgacaaaaaggacagcaaactaggaatcaagaaactgagttctggttcagactctggcactcatgaactctgtggacctggatatgccactttacttctttaggctctaattcttcatctgcaaaatgaaaagtttggtgatggtttctaagagtactactaactctgtaactctgtgattttacagttcttttatttaccaatgagaagcccagacacaacatttaaatgatagattttatcacatctctatgccttcttaatatggtgtccagaattatttttgaagatacagtatttaggctgaatttcctaattagtgtttagaatacttacagaaaatagcttttgtaggtatagctaacttttgattatccatgctaacatgggataacatgtgtaattgaaatgtgtatgaagtcttcactcctcattttctcttcaaatttgtctccttttggtaaggagacaaatttgaataaagttgctgaaaaatatgggtttgagtttcattttcagcctgggcagaaaactgcctttagcatctttgtatagctttattttacccacaccactttgctgaggaaaagaaaagtattcattccatatatatatatatatatatatatattttttttttttttttttttttttttttttccagagtcttgttctgtcacccaggctggagtgcagtggtgcgatctcggctcactgcaagctccgcctcccaggttcatgccattctcctgcctcagcctcctgagtagctgggactataggcgcccgccactacgccgggctaatattttgtatttttagtagagacagggtttcaccgtgttagccaggatggtctcgatctcctgacctcatgatccgcccgcctcggcctcccaaagttctgggattacaggcgtgagccaccgcgcctggccataggattcattattaaaccataggaatgagcctcattttatcctggttggttttttaaatctcagaggcacattacattcgtgtgcatactgtccacatctactttacatcttgtgtacgtattgcttcatatatgtgcctcaggctcttgtgcctccatacctttacttgtgttcttcctgccatattttttactcctgttgccctcagacacagaagctctactcatcttataaagcccagctcctcagcccttgatattttccctaagcatgtgagccttattatccaacagattgattccagattctagtgttaaaattcactagctctctgatcctgagaaaattaccacagtctgaccatctgcaaaatgcaaacaattcccaaatctcaggatcgtttttaattttaaatggtatataatccggtcattcaataaatatttaagtagtgatatcacctatctgtagaacaaaatagaccaaaaactctgccctcacagaacctataccctcgtggagataggtaaatacataaaaacaaaatatatattttgagaaatagagaagggtagaggagagggagagtagagaatgcagaaagtggagaaactattttaaaataggatggtctgaaaaggacttcctgagaagatggcacttgagcagggacctggaagagccagggaatatttgaaggaagagtattccaggcagagggaactgcaagtacaaagtctctgaggtgtgtgtatgcttggcatgtgccaaaacagaaaagaggtcagttggctcatgcagagagagatgaggcagaaagaacaagccagatcatatagggtcttttaggtcaattttagtgaggactttgccctgaatgagatgaggagccatcagagggtttttgaagagataagtcacttgatctgacttacctttttaaaatactgtgtggcttctgtatagtttgtgggggagggggagggggaggggcaaagtaaatattgattaagctattggttgtaatataccaggtgagagctacacatcactacagagtctttcagaggatctagacactagtaggcattctataaatgttagtgccttcattctcactttctcttcttcatattcctagttggaagttttctcttcttctttgggattatctattatgacgcataccattttagaactagagttatctgtgtatttttttttgtttctcctactaacctaaacatttcttgaggataccttcttgaggctcagttttatctgtctttataaatggatcctatcccagctcaggatagggttatataagtagcaggttgagagtgtgtttgggacctgatgaacagcaacatccaagaggagaaggttagcaagtgtgggaggatagggaagtaacacttcaggagacacacgggaggtgtatcttaggatatattagcaaggaatagtgggatactttaagtaagatagatgtgggaagaggcactggtcctacactacatgtgggagatgccaggacagatctagttaggcatgctgtttagggactttggccatcttcatttgtgattcatgaagatgtgtagctggggtctgaggtgacatagtgaagtgcccaaacaggtggataatgcaggcaaaggagtctccccacaagggccacttgggagtatagataaactgctcgttgatctctgggccatctgtttatgcgtagtaatttcatagccttcacagggggattgaggtagatttggcaaattactggactgggaacttgtgatggtgctgtaccctttaggatttttgcttctgcaagtggcagattacccaactcaaaggagctgaagaaaaaatgatccttggtggctcatctgactgaacaattcatagggagttattgtcaaacagtttaacttgatccagctgcacaaataatgtcactaagggcctggattctttgtaattctctctgctttgcctttgcctaggagcatcctcatctaaatagggggctcctggcaccttcagcctgacatgttacaaatatcttatcttcaatacaatcttatctggtagaagaaagcctttttggccatcacacagaaactctggacttcagtctaattgaaccatcttaaagtgtgtacccattcttaaccattcatttctagtgagctaggattacattgatgaacacaggcttcagcctcttgcctaatccacagagccagggatagaagaagttaccccaaaatatgtgggctttgtattgtggatgtataaacctaactgaaaattagctgcttttattaagcactatatgaaatgggatgtggatttgggcccagcaaaacagtagatgtccactatgggtattatattatcagggccccagaaggaaacacagttcagcttagatagctcaaaagaagagactttaatgaagggactacttacaaaggaatgggcagggttaagggcacaaaacaatggctggtgagcctcctagagaccagtatcagtaggaaggtattaccaaccctaggacctagggatcaatgggaagaagtagtgttgcccgggtcaagtaagaacttgagtcctgcaggaggagctagagctgtagctgcggagtgcagctatagtcagagatgaaacattgattgaagcagggtgggaaagagaaaaaaataccctgacccttttctcttttcaactcctaatcgcctgctgtagtgcccattggctcaattggaacgaggcagaaatctctaggggtcagcctcctgagacacatagtggagcagaatatggatcttagttgaggccaaatggaaaataatgagcacagaaaacaaattagagtctcagtcttataatagggaaatatattgggaaggaagatagggatgaaaatttaggggacagaattttattggaagaaggtccaattgaaggagtgctaacctttcacacagcgcagattaagagagttaaattgttaaaggggttctgagctccaggtcagtctactggagggactgatttggttgtaactcctccttgtggtggggaataggtacctactcactcttaatgctccatatcagaatttgcctgggaactggaatgtggctgctcctgaagacatggatctcagaaggtctgtgggtgggtaagtggcttatgacgggaacagaacaaatgatacattgttgtgtatcaaggcagaaaccattactacaacatgtagctgccctgagttcagttgcttttgtttatgttcctgcccagccaagattgggatcacttcctgctgagacctgacttgaaaatgatgggcaaatcttggcccaaatagctaactagaagtgaatgagggtagccctaccagtcttcatctagaagccatgctatagggataggggataattgctctcaccagctgctgagacaaattcataagtgacactgtggcgaggggtcaaaaacaacccaggataaagcaggaagctcaaattgtggctaacagtgaggaggcacacaaataacacagctctaactccactgaagacagggtaagtgacagcttcccctgagtcagatggagcggggataagtgtgccttgatgcgaagtgggaaaccagaggaggacctgactgagcaataaaactcttggctgagactaaaatgatttcaaagcagaacaagggtgggactgtttggtagtggaaaagaaagcttggtttgatgcctagagagagaattacatgatatgaagaaaggtcattatttattacctaatcaagcagtgtaaacataccaacaagcttgagacagtctttatctagcattattagatgtgcaattcaggtgagagaatattaccaaatctaacctgcttatcaacacttgtgtaatgagaacataaaagtgaatgaaaatgtatctagtctgcaatgaagtggtaatataagagactcagaagatccttttttcctactttgtgggattgagcctaaatttaacttgaattatttttagaagggacttcttatttagcctttttaaaagaagaatttatctattaataggaaatatgcattttattattaaaatgagttttattttggagtagttgggaaatgtggaaaggagaaaccagttgcaaaaagggatataaaaagaaagttgtcaaaaatgtttaaagatagagtatagcacaccaaaccccacagccatctgcccaggaaactctccttgttgccttgttttctctttcatttgtgtgggctgttctctgcttaggtgcttggaatgtccctctgatacagaaatggggaagggaagtgctgggaagggaagggcatggtccctttcaatgatacggaaggggagaagggtgtggtccctggctagggctccgcctccaggcctgtgcccacaggtctagttgaggacaggcatttttgttttcctgcccaaaacatttcctaagaccaccttggtctgccacgcccgcatcctgtgcctataaaaacccccgagaccctagcaggcagacacacacacacaagcgactggacatcaagaagaacacatcagaagtagacagaagtggctggacattgagaggacattgaggggagcacgccggatgctagcaggctgccgactggcagagcatgcgaagtttggctggggcagttgagggagagccccggctgccaagcagctcgactctaggggaaaaccaatctcctttctggctcccccatctgctgagagctacttccactcaataaaaccttgcactcattcttcaagcccaggtgtgatccgattcttccaggacaccaaggccagaacctcgggatacagaaagccctctgtccctacgataaggcaggggtctaattgagctaacacaagacacctacagacagctaaactaaaagagcaccgtgtaacacacacccactggggcttcagctgtaaacattcacccctagacactgctgggggtcggatccccacagcctgcccgtctgtatgctcccctagaggtttgagcagtggggcactgaagaaatgagccacacccccatcacactgccctgtgagggggacaagggagtttttcctgtttcacctcctcccctctctccaggccaagtcttccttgtactttaagattttaggcaatttgactctcataccttctaatatcctcttcacttcaatgccaccccagatagatctgtgatatgcaaatccgtgttgtgatgcacttatcacagtgtactgacatgactttctgatctgtcttctccattagactgtcagccatttgagggactgaggcagtaaaagagtaggtatttatatggccagaattacattaaaattacgtttgttataatgaagtagaatatttctgtgctttgccctttccactcactatcagatggcttcacagcattcctctggaatgttctaaaaatagtctgacaccaaatattagtttgaactcttgattataagcaatagaaacccaattcaaaatagcctaaataaaagggagagtgtagaatatcttggtgtatatttcagcatgactgaggcatgatggaggcaggcatacagctaggctttggaaatacggctcacatgcttttgggactctggctattttttattttggcttcttcatctatttgggtctcctctttctctgtagaacagctttctaaattcagaaaatatggttgctgacagctcttagttttacataataaagctttgccactacagaaaaactagaaactgatttgagtttcctatctccaaagttcatgggtcctaggaaatgtaccagtttgggccctgcccaattatcagatgctctcattgtaatcagatggagagggtgagtagttcctgcagccaggcaaaatagtacatgctgtacacacggcatattagtattatgggagaattacatttagagggctctgtttgccaggacatatagttaagtccaggccatacatatttatgggagaagacaagtgctccaaacagttaaataaacttttattttggcatttgaaatgcataatatcattattcttatgggacatttaccatctttattatgttctctattggctagcattaagatgcattctttgcattcttaagcataaactaacaggagcatcaagaaggaaaagtagcctggataatgaaaaaagttgacttgggagcaaaactatgctgtggttaattgataaagcagaggagtttctgactaaccgaaaatatttttagtcttccaaaaggtattactaacatcttgcaagtgaatttttaaatataactttcaactgaaattttcttaccagcttactgtactgatccaagggtatgacagacattaaagtaaaagaaactggcatggttgctcatgcctgtaatcccagcactttgggaggccaaggcgggcagatcacctgaggttgggagttcgagaccagcctggccaacatggtgaaaccctgtctctactaaaatacaaaaattagccgggtgtggtggtgggcgcctgtaatcccagctacttgggaggctgagacaggacaattgcttgaacctggtaagtggaggttgcagtaagccgagattgcaccactgcattccagcctgggtgacagagccagactccatctcaaaaaaaaaagaaactggcatgtttgctactcttaacagagaagtaggaagtagatgtgtttaaagctaaacaaccttttaaaaacatcatgtttacagtgttaaaatttgtgtgcatgtgtatagcttatgtacgctaaaggccgatcttagatgtaaatcaaatgggtatgattttagaaatgacacattacattacaaaaaaaaggtaggtatgtaaaatgagcttaattattttcccttttgtacttcacagggtggggaatggtggagaatgctgagtggtgatttggggccataagtccaacattctgcctactttataacaactttattgcaggctggagggctgtgtgtttgtgtgtgcgtgagagagagaggggagaagcgagaaagagagagagaaggtaagagggagagagagagagggagaggaaaagagagagaagagagagcccttggtttagttattagggaagagcaaggagatgctggtaatttgatatctaatagtttactgacttttctctttgtatacacattttataggagtaaacaatggagaatgatgtgagatggattacatgaccaaacattgcttctaatttgaatctatgagcctttgaagccagatataagttgatgtatcaattatattagtccagagccaatgtataatttctgtatcaatcactgtgtttcttattattcggttagaaacttgattttaccgctttcagaatctaaaactctggttattcatcaaatggacacaaaatattaaaagaaatagaccttttccatagtctatgttaataaacccaggtcatcaatctttgttcgcatatattatgtagtcccctggtggacagtgtgttatttctgtttctggtttggtaacagacaataatcaatctctctcccttgcccccacctttttcctttccagtctctgatccttttcctccttttctttcctctctctttctcttcctctctccttaaaacatgcttatctgtaagtattcatgaagacaaagtaccctttgtattacctttgtaaataatctaaatgagcattttctgcagtgatggggattgctgacctcaaatataattgcttttatttcgacatcttaaagctaaaagatttcttttttatcatcataatgcaatttaaatttctctcttaccttctcgccttttctcttttttctatatgtctttctttttccctttcttgtcctccctcccttccttcctttcttccttcctttccccctcactactctttctttaaaaagcatgacatttgacctttggttggtactaaagcttatcttcagggagaatgtgactttgaaaattagttatcatacatagaatacatacagctttttgcctacataaaatgatggttctcttcaggaactcttgattccagtctgctaatattgcaaatctaactaaaatggacattgtctttgttgtacgtcggtgagtgacaagggttctgcacttagagcttttgctagaaaacctggagggcagccagccaagagctctgtaatagacttgaagaagttggaatctgtaaaaaatgtttcaggaagaaaatctttcagattagacagctgcatagttaacaatcagtagctccagagaactaataattagttctagtcaattaaaccaacttttagccttatgacagagaagatagcttgcatagctaaaatgcacagtatactcttaatttatgctacccaattccttaccaaaatatttttgatttttgtttgttttgtttcattgttaacattttgttgtagttcctgttgtgggttgtttggtaggttactatgtaccatgttatagtatttttctttttcatgtagtattctgttataagccatttccatgttcttaattttaaatgactgcatataattttacagtaataattatgtaccaggctaattattttacatatattaattattttagtctttataacagttttttgaggcaggtactattattatcctcatttaaaaatgaaaaacaaaaatgagatacagggaaggtaagtggactgttgaagattccagtgccaatacatggtagaggactgaatttgtgatggtttacttacttccttcttatccacctattcttagatattatgtagtttcttatggtatttattgtaaatatcataagaaccaatgtcatgattagtaaagtgtttcccaatagcaaagacattcttgcaaggcagaaattgagaattgaattattgtgtttttatcaataaattatagttagactcataaacctgcatattttggaatcaacctaaatgcccattaacgatagactggataaagaaaaatctggtacatatataccatggaatactatgcagccataataaacaacatgatcatgtcctttgcagggacattgatggagctggaggccattatccttagcaaactaacacaggaacagaaaaccaaatatagcatgttctcataagtgggagctaaattatgagaacacatggacccatagaggggaacaacacacactggggcctatcagagggaggaggttgggatgttgggatgagggagaggatcaggaataataaccaatgagtactacgcttaatacctgggtgatgaaataatctgtacaacaaacccccatgacacaagtttacctatgtaacaaacctggacatgtacccctgaacttaaacaaaaaacaaaaaacaaaaaaagatttcctcctctttaagagtatttccttaggataggttcctagaaataaaattactgaatcaaagttttaaaaaaatttaaggctgttgatacacagtcccttaatagctttcttaattgttggttacatttctgcaataatttatgtgtgcacagtttggtaaatcattgtcatctcttgattttatgtttttaaatctttgctaatgtgacagctaaacatggatttcttttacctttgttgtaatttgcttctttgtatttgaacttcctcttgtgtgaattattcatgcctttttgcctgtttttctcttaaagttctagtcttgcttttgtatctttgtataagtcctttaaccaagatactaatctttattatatttgctggtaatgtttttttttttttagcgatttgtctttttttggactattcctttttacctatgaaggatgtttttgtttatgttttttaaacacaattttacttcttttgtgattgctgctatttacaaaggcctttcatttatgagattaatgctaaattatctttttctctacttgcactacagatgttttccttttgtgttaaatttttaacgaatctggaatttattttttatggcatcagttatgtatcagaattacaagttagtagaaaaatgtttcaagttacattcttctctttcaatgaattgattaaaacttggaagaaaggccttggataatctataaactatgcaatcagcttcttaaatattcttttctctttgaaaggcagaaattgagaattgaattattgtgtttttatcaataaattatagttaggctcataaacctgcatattttgtgctttaaaattataatattttgtcttttgctttcataaagaaatcttacaaagggaaactagaatctagccttccttgttctttgaggttctatgtgcctcactgatgatagtttattatctctggacttctgcctgttatttaaaactgagaacaagacaggcgtggtggctcacgtctgtaataccagcaccttgggaggccgaggtgggtggctcacgaggtcaggagttaaagaccagcctggccaagatggtgaaactccgtctctactaaaaatacaaaaattagccaggcgtggtggtgggcacctgtaatcccagctacttgggaggctgaggcagagaattgcttgagcccaggaggtggaggttgcaatgagctgagactgcgccactgcactccagcctggtgacagagtgagattccatctcaaaaaaaaaaaaaaatcaatatgtattaggaacaaatattaaaatctaaaagtgggatggatatatatatatgcatgtcacatataacaatatataatatatattgctaataatatgtaatttaatatttcaagaaaagcctgaccatataaaagtgttaaaatattggactataatactgagactcctaaataatatgtaactactatttccaagatgatataaataggagtcttttatcttctggaataattcttcttttcgtcattttactactaattatttgataacccttatttgtgttttagctgcatattaaaatgagtggcaaattaatatagatataatgatttggcagtgttgaataaggctttttcttttcttcacccaaagtgattgtatttaaaatgcatgttaatcaaaattcagtgactcatctttgaggtttgtttattacctagattcattggtgtcaaaactgtttgcttaagatttgatccacacccaatttgtacagtgtcttttgaaatacaggaatttggaaattttattagattagaagaaacacttctgttttatagcctactttccttctactttagttatttttactccatgagaatttttcattaaaaaataattgcagtccttgacacatcaaagacaacataattactgaatgaatctccataattatgtctcttttgtaacttacttttgcttatttatttttattgttcaaaagagcacactacttagaagggaggcagaacctctaaatcagaagtaaacaagaatataagaagaaaagaagtgctataataatgtaggtattctacagactacctagttgcagaaagcaatggattcttagttcttgaggagctaatggaagagatctaaaggaggtagaaattctcaaacatctgggcatttgttagaacttcctttaaacaagggtagtactttgggagaccaaggtgggtggatcacttgaggtcaggagtttgagaccagcctgaccaacatagtgaaaccccgtctctattaaaaatacaaaattacccggatgtggtggcacatgcctgtaatccagctacttgggagactgaggcaggagaatcacttaaacccatgaggtggaggttgcagtgagctgagatcgtgtcattgcactccagcctgagcaacaagagcaaaactccatcttagaaaaaaaaaaaaggcactaactctattaaattatttattttttctttttgttgtgtgtgtgactgtgttatttcaaagattgtcttcaagttcagaaatttcttctgcttgatcttgtctactgttgaagctcaattgtattttttaatttcattcattgaattcctcagttttaggatttctaatgggttcttttaaacatctatctctttattgaatttcttattcagattgtgaattgttttcctgatgtctttgcattatttatctgtgttctcttgtatctgagttcctttaacatcattattttgaattccttttcaggaatttcatagatttttttttctttgggttctgttgctggagaattattgtgtttctttggaggtatcatgttttcttgcttttttgtgtttcttgtgtccttctgttgatacctgtgcatctgatgtaacatttatttcttccaatttcatggattggccttcactgagaaagatttttttctataatcatatccatagtgtttgttgggtagggtgctttggttttgattctgggtaagcacagtagtgtagtcttcatatgatttctttagctgtaatcagtgtcaatggtgtgagttccttagaggcttaggctgtggttgttagtggaggctgtggtgaggctttactggggacaggaatgccaggtgggctggtccttaggcacccatggtggcagtctgggcatgccagtcctcaagcccttgggcacccatgtaggtggcagtggtggcaggtccaggtgggccagtccttgggcctccaggtgatgtgcttgggtgctggtggtggcagggtgggctaggcgggcaggtccttttgcccagtggtggcagggtgggttaggcgggcaggtccttttgcccctgggcagtgtgtgtggcatcagtggtggtggtagctatggcagcttaacccttgggcccctgagtggtacatgtaggtgccagcaatggagggactgtcctaaggcccagggatggtgtacagttggactagtccccaggcttcctgaaggtgcatggcagacctgccactggagggggtggggttgctgtcaatagcagtggccctggtgggcaagtagctctcaggctctggagaatgcatgcttcaacttcctttgtcccaggggcaggctccctggtgtcctgcaccagctgttctcttgagtatcggatactgtgtgggctagagttctagggacccacatcactgtgtctagctggtgttgaagcctgcagatttggggtaaatgtgaggggatgtcagcagtgctccagagatgtggagatgcaggagctgttgggtcctagagcaggacgtagtctggtgggggctgagctcttaaaatggtgctgtaccatagctgcttctgtctgggtatgtgtgtgtgacccagtgtgaactcctctctgaaacaatgccatcatgtggactccaggaagctccttatactagtctcagggcccatgagggccaataagggtctgcaatgggaatgtggactgcttgggaatctctcacataccctttcctcatagtggaaagctccttctggctctgaactgatcccggccaggccagctgtttcacatccctttcctaccatgtctcagaggtttcttgtcacttctgtgctgaattccagtgttctgtcttagaagctttattcaaaatggggttatctactcactgttttggtccttctttgtgtaggaggcaagtgcctggaacttctagtcagcctcttgaacccttacctcaattattattatcattttttaaagaactgtagagtctcataaggcgtagaagtgacacaggacctagtactctacataactatggattagagagaggaatttcttcaagaagtagaaatgatagagaaggctgtagagagaggaaatgctgtaactagctacatatatattctggacttaaaaaactgtttcagatttcaaaaatctcagggaaaagatagatttgatcaaatatctggaacaggaaccctgattggaacaggaatctgtattgtggcattatttatttctctggtgcccatagaagacattatttaagtgacctcaataatctctcatttttcctgaaaacatctctggaatccttcttaagataatactctaggtagttactactgatgcaggatgttttgctcctcagctcagctaggtttggtttcttgtctcatgaccaggaagaaataggcaagtggacattgaagaatgagtggagtagaatgtattaagcacaaaggaaacccctcagccgaaagaggagttctgaaagcaggttgccggttgccccccttcacagttgagtaccaatactttgttataaaagctgatggggctgggttccctatttgtataaggtgcaaattcctggtggctccaccccacccttccggtgcgcatgcgggcccttagtctgacccacttcacattgatttatttcccttactgtgcttgtgttaagggacagaattttttactgcaggcatatttaggcaagcctcctgtgctaatgaacttggtgggttggaggttctcctgggaccctgccctatctgcctaggagagttctctgcctcctgtctctgtcactaccatttgattgtctttgcaggaagtggagcctgacaccctagtgtaggagaaaaatagctcaaaatgatacagctttgaatggcttgcctctctgctatagatctattcatcaacactcttggatccaatagttaaatagatacaaagccttctaattcttttattattgagcccatatttttattttatccatgaggaaagcttgagaaatgttgtataatgttcagttaaaatctagatgacagtgcttataggagtaactaggtctgttagtttagtaaaccacccaaaaaggtaatctgtgtaatgtgtagcattggttctccatcaggggcaattttgtccccctaggggatttagcaatgtcggggggtgggagtggggttgtatgctattgacattcagtggacagagcatagggatattgcaaagtatcttacaatacataggatggcccctcacaacaaagaattatccagtctaaaatgtcagtcataccgcagtttagaaattctgatctagatcactggttcttgactgggaacttgttagaaatgcaaactattgcattccgctgtggaactgatggggcagaaactctagaggagagtctcagcattttatcttttaaccaacccatcaggtgattctgatgtaccttaaagtttgaagaccagttgtgggaccattttggcatataaaaacgttcaggaaatatttattgagcatcaagcttggaccacgtgcttctctaagtgctcaaaaaacagtcttttcatagtttgcttttgccatcttacctatgatcttgttatttcttgtagttctcaaattcttctgttgtctaacatgttgtttgatatgtttgttaaattgtattaaatcgaattggtagctggtctttttcatcccaccatcccatgaggcttttttttttttttaagtcagttacttgcttgaagatgtagtcgtcatggttatcaatgttttaggcctcataaagatggtagggattggatgatagaggcaatctttgattcttaatagactagcaataacatggtcatatttctaagttccaaaattcccattatatcaattttaccaagcatttcctacttgctaatcagaattaggaacatatttcttaactgagtacattgcatacaagaagagatttttaaaatttgtcgaattgaatcaaagacaactcctaggtaacttggaagaatgatagtgataataatagaaaaaggaaatttaagagaaagatgggcaatatgctgagttattttgtacttagcgaatatcagatggtgatacacactaaagtaaatatattcatccatcaatggaatcaaaagcacaggtagaagggacacttttttttttttgagatggagtcttgctctgtcactcaggctggagtgcaatttcagctcactgcaacctctgcctcccaggttcaagcgattctcctgccttagcctcccgagtagctgggattacaggcacatgcccctacgcccagctaatttttgtggttttttttagtagagacggggtttcaccatgttggccaggatggtctcgatctcttgacctcgtggtccgcccgtcttggcctcccaaagtgctgggattacaggcgtgagccactgtgcccggccagaaatgacacttcttgactgacgagggaagaataaaaggaaagtgacataccaatacaaataaattttgttgtaggaagcagttagaggaacttttaaataatggtttcagttgtttctggaatactttggcacgtcagtatctgctacattgccaaacttccttagcttatatgagaattctgtgaggaattccttgtgaaaactcgactgagggtaaaaaattacagataactcagaaagctattcggttatgaggcagaaaagaactgctacaccatcacaacccctatcaacagtgacagcgaagaacattaaataagagaaaaactttgaagacatataactttaggcagtaagtctcattatccacttagcctggaaggagagatagccgtgggtcatacaattccaaggtttgggttacccctctgggcaaaaaccttatcaggaagcattttttgaatgcaaatgcaaggtacatgtagtgagtcctggaggaaggaattttcaaatgccagccaaggtagaaatacagccttattttctatttgcatttgtttattgctaataattgtcttcttttttcctttttaaaataggagttgaagtgaaaacaatttctctgttggaaattgatatgttgatagtgtgtggttactgctgaactagaggaattctgaacacttcttgaggattctggacttgaagaagagtaggtccatgatgttgatcctggatgtagttgttgaaggtgatttggggtcagcttcctttggggagagtagtgattatattgtagttgtagtggaatagatggattacagggtcttgggtatattgaatcatctccctttgtggggagtgattatattgttcttgtagctagatagttggattgtgacatctttggatatacaggaaatagtggatgttcatatatggggcaaggccaggggttggcatgttgtgggtacctttctgggatagtgctcagtgcatggccattttctttctctaggacttttccctgaaacccagggtggagttcagttggccgttagcaccatatagctacaactcagttgtcacaactgaagaacccaagagttcagaacagattaaagctgcactactcagactctcatgtggaaatctgaaattgatagtagtgttacagagagtaggttcccaaactacactgtagagtttcctatagctgatttggcttctgttttaacaaaagtagttgttgatctctttgtgcatttccatcgagactgcccagtgttctatcaataaagttccctgtttgtgctgattagagttggttttctgtttcttcctaccaagagtcttaacttaagctggtcatatgaggtggtatgagcctcaaaaagggctgaatacttgaattatgacagtagactgtagatacagaagtggcagcaaggagcaagatacatgttgatccattctcctaaaagtagaagaaaaaatgccttttattggagagagtggggagggatatggctcattttttaaaagacagttttctcgtactatgagaagaaagaagtagtgtgttaaactcaggctgaggatgttagctagtgtgctcctaagagatttatgatttctggaggaattgagtaaggattatatagcaaatgttctgtaaatatttgatgaatgtggaaacaaataaattgaggagaatgatcccttctcattataacctcagtaaagaatgctgtgtgccacaattggcctgggcttcccaaattatagcttacttgcataatcatttccatggtaaaattgccaaagctgccattctctctgggttcatgttcttttccctgccactcatttttggtcaatacagtactattttagtattgaagtttagttagaggaatttgagtaacttttacttttagggagaagagtttcaaggcctctatctcttccctctcagaagctccaggagacaggcaattttttttcatgatttcaccaacaaatagcaagccctctctctaagaaatgtcaatgatgctggaaaaaaaataaagttccattttcatgtgatataacatgtgatattaattagggtaatactagccatgaaaagaatagacttcaaaatataaaatggcttaaaaccaataatttatttcctgctcattacagggaaggtaagcagattactaggtggcccttcttgtgggtcatttagggactcagatagggaagcctaccataatcagaatgtggtttccaaggttaccctaggtactgtagggcatccgagccagacataagaggaatgagcatggggggttttgtctagagtggaacatagcacttctcttaactttcagttgactagaattcagtctcatagccacttagtcgcaagggaggcttggaaatgtagtccactttgtgcccaggaaaatggaatatatactgtatttggatggtcaactaacaatttttatctttgtggctactcactattattcagacctcactttccagaaattctgataaatacaagtttactgtattttgaaaaaaagaaaaagttggtaaacttgcctttcttcacagtttctgtaaattccatgacttaaaaataaagctcatattgagggaagaaaattaatagatttgaattagctaaattatatacatatgtcttttgccacatgtactgagaatcgctaaacacatttttcatattcaggccttgttatcaagctgtaaaattctaagctaacaaaaaccatccttcataaaacaattctaggaccaggaaggataagtcaaactgggatttgcagattgtgagtaagtacttaagtgaattggactagagaaaataccaggaagctagcagctggggtaatgtcagaggtagaatccacatgtgcagctaaaagtaggaacctatgtcggcacccaaggtgagagacagttggaggctggatgccttatttatagggactttgaatacacttcctgctgggcagcagtgaagcccatggtgtggacagctgacagagaagaaaagcaggtagataggctcacctagatgaaggcaggtttgaagagatggaggccctacacagcagtcctgagaagaattttttttactaattcaggattagcaaattgttttcctggtggtttttggttttgaattactatgttgcaaagttggtaatcttagtgagaatacaagaaaacataaggttattcacattcaggtttattttgttttgtatccactgtgatgattaaaattgggattaaatattcaagtgtacaaatacaattaaaattgtaacctgtgcccaataagagtggtaaaagtgtaactcagtcaaaagaaaagaagctctaagctttggtgctgtgtatcacctatgaattaaaagatatttttcagatgattggctgattggcgactctggaactgggaacaagttaacgctgagaacaccaagtacagtgcgtcatgtaaggggagggagacgcttaggattacatggttagctaagaccatatgcattgaggtttcaagtctacaagcatgatacttttctttcagagtttgttgatactgtgtaagggtgtcaatcattggtacattcataccagattgcatggttttacaagatgaggaattatacagcaaatgaggtaaacgtatacattgtggattcctttataatactgttctatcaggaaagtaattgggcaaagaagagtggttagcaattgaggttctagagtcagaactgggctcagatcctgatgttttcatttcctagctttgtgaccttggacaagttatttcacctttgtaagcctttgtcatctttaaaatagagataataactatattcaaagcctctgaaaatcaaaagttttttttttaactcatttggcagcaaaacttgatgtggaataatgacaatttatttgttgtctttatctcatttaatgtgcatctttatacattttgtggcagaaatattgatatatttgattaatgtatgctactccagaatctactcagggaaaatgctagatagctttcatttatacctccagattcactgtccacctttctccatctagctatgtgtccaggagtctgatagtatagattgtaagtatgcagtctgtgtttacaggctctctgctatctgctttcccattagctctggccgatggaagtcactggcgagatattggagtgaggcagcagagtgagagaggtatttaattcacctagttctcttcatgagtggtcaccgtagtgtgtctctagactgaaggtctcagcatgtgaaaggtaccacccctcacaaggcctcttagtcttcagctttcagtaacagctcccttcctttacccattatgacccagaggtggtaatagtcactacagtgctagcttcaggttatcaagctatcctttgtggtttctctacaccttagcaaatagtgcctttattaaattttcctcaatttatcctaagttgaccatgtacctacttacttctcagaccctaaaagatgcatagtactgtttaatttatgaaatatttactaaattactgtctgaatacatacacatgcagaggcacaaacatacacacctgaaacacatcttgcttcaagggttttggatgaaggattgtagatctgtattctaattatattagcataggaattttactgtattttataaattattactgttcaaaaaattatattaatgttcagttaaacacagagcatgtaaatggcctacaggtaacaccaccaacatctcagttctaaaaatatgaaaaatgtcattgagctaccaatttaaataaatctcctaaagtgagtatagtatatggagcgcagtttcacaattataaacttgcctttgttacttaagaggaaaaaagcagcagcaagattagaccttaattccacttgatcacttgttcatcaacaaatggtcttctcacaaattccaagacgccttaagaagagatgcccagccggtagcattaacataactttatctaaattatttcgccttctctcagtgcttcaacaggaataaattcagcttctgaatttttgccagtgtatgacaatgtattttctagttagctgttgggtggtggaaagaatgtagaatttggagtcaaggaagctagtttgggtctcaacattgataccgttcttgagtcactgtgagcttgatttctgtagtccctgtctctaaaattggggtaaaaccacatacctgtcaggatcatgaggattaaacagagtaaatataaattatctagtatggagctcagctcatagtaagagcttgagtgtttctcaaacttgaatcagtttgtgaacatagccactcaatagaggaaggtttgttcctggggctgatccatgactgcagctgtgtgactgctgttgtggcatttggactgttcatggatggaccagaacctccagattctacatgtgataaccgtggctgagtaaaggctgttgtcagtatacatcacgcaacaacagaatgagtgtggggtagtatttgtgtaatttgccagagaagtgaggaactgaacagaatgagttttttcttgtttgtaaccacacatttagtttatgcttccattaattcataagtattatatttagcactgtaatatttaatattgatgttaccaaatgtgggtcaacatttaaagtctataaaaacatgcatacagtcttgatatttttaaaactcactatagtaagcttcacttttttctaatgaaattcactaaccagtttaagaaaatggtaaggttagtgtgaagaattccatgccataatactatagaattgctagagatgggccacatagttgattttgagcttctagtggcaaaaaaaaaaaaaaaaaaaaaaaaaggccaattataagatccctagagtcttagttgctttttggtaccaagatctgagagggcttcataaagtggcatacaagattgagaatttacacaagcagttttgaatagaataacagagactttagtaacaaatttaaacccaagcatagcaagcaaccttgttgaaccaaatagttctgtgagagttggcaaatcttaccgggatatagcttcaatagtgatgatggaatgataagaaataattgcctttttgttaaattttttatttgttaaaattagtaatcaactctctatggactgggagagctcaggaacaatatagctttaaaaagtttttcttcggcagtcaaaataaaatattacatttaaaattaattgaatctgtgaatatgattattaagataaaatgttatttccaaattaaattaaaagttttctttattttttactatcattcttctcctcaaattaatattccatctgagaagcctgaaaagagaagattaaaaggagtcattaataaaaggaagtgcatttaatgggaatatgattatcatgtagttcaaagaaaatttcattgtgcctcatactaattgctattttgtgcacctacttgccttgcttatcttaagatggttttggctttaggggaagtataaaaaattaaggtatacatatattatttaaagtagaccaaagttaaggcataaataaatagttaataattgaagcatgtgagtcagttaactttaaaactgtacttattaaagtctttgttacttttaagaagactatcctacgctttgagaaattgctgagtcatggtcatgatcacatctgtgttgtagttgtagcccccctgtatgggaactatgattcctgccttcaggctaaaaggcattaaaagaaaacaaaaacaaaaacagagagaccatgtagtgccatccccttctttcaagtgtgaactccagctcaatttccccctgctcatgtaaattatttagagctttcaaatagttgttttaaaatttttcttcagagtttgtagttgttatgtattgaacacaatggaagtgggcataatcttttctctgcctaaactctttaaagtttttgaaatgaagacatttaatttttttaacatttaacctgatataattttaactgtttctacctgagaagttatccagcaatgttcttttttttttttttttaaggttttttttttcccataagttataggggtacaggtggtatttggttacatgagtaagttctttagtggtgatttgtgagattttggtgcacccgtcacccgagcagcatatactgcaccatatttgtagtcttctatccctcgctcccatcccactctttcccccaagtacccagagtccattgcatcattcttatgcttttgtgtcctcatagcttagctcccacatatcagtgagaacatatgatgtttggttttccattcctgagttacttcacttagaaaaatagtctccagtctcattcaggtcactgcaaatgctgttaattcattcctttttatggctgcctagtgttccattatatatatatatattccatcatatacatatatgtttatatatattccatcatatatatgtgtgtgtacatatattccatcatatatatatattccatcatatatctattccatcatatatatctattccatcatatatatctattccatcatatatatattccatcatatatatatattccatcatatatgttccatcatatatatattttccatcatatatattccatcatatatatattccatcatatatatattttccatcatatatatattccatcatatatgtatattccatcatatatatatgttctatcatatatgttccatcatatatatatgttccatcatatatatctatgccatcatatatacacacacacacacacacacacacacacacacacacacacacaccacagtttctttagctacttgttgattgatgggcatttgatttggttccacggttttgcaattgcgaattgtgctgctataaacatacatgtttaagtatctttttcgaataatgacttattttcctctgggtaggtacccccccagtaatgggattgctggatcaaatggtagttctgcttttacttctctaagggatctccacagtgttttccatagcggctgtactagtttattttcccaccagcagtgtagaagtgttccctgttcactgcatccatgccagcatctactgttttgtgatttttttgattatgtccattcttgcaggagtgaggtgctatcgcattgtggttttgatttgcatttccctgatcattagtgatgttgagcattttttcatatgtttgttggccatttgtatatcttcttttgagaattgtctattcatgtccttagcccactttttgatgggattgtttgtttttttcttactgatttgagttcattggatattagactggatatcagtcctttgtcagatgtatagactgtaaagattttctcccaccctgagttgtctgtttactctgctgactgttccttttgctgtgcaaaagctctttagtttaattaagtcccagctatttatctttttttttattgcatttgcttttgggttcttggtcatgaaatcgtaagccaatgtctagacaggtttttccagtgttcttttctagaatgttaatagtttcaggtcttaggtttaagtcctcaattcatcttgagttgatttttgtataaggtgagagatgaggatccagtttcattctcctacaggtggctagccaattattccaccaccatttgttgaaaagggtgtcctttccccactttatgtttttgtttgctttcttgaagatcacttggctgtaagtatttgggtttatttctgggctctctattctgtttcattggtctatgtgcctgcatttgtaccagtaccacactgtttggtgactatggccttatagtatagtttgaaatcaggttgtgtgatgccttcagatttgttctttttgcttagtcttgctttggctatgcaggctcttttttggtttcataagaattttagaattgttttttttaattctgtgaagaatgatggtggtattttgatggggattgcactaaatttgtagattgcttttggcagtatggtcattttcacaatattgatttcacccatccatgagcatgggatgtgtttccatttgtttgtgtcgtctatgatttctttcagcagtgttttgtaggtttccttgtagaggtctttcgactccttggttaggtatattcctaagtattttatttttttgtttgcagctattgtaaaaggggttgagttcttgacttgattatctgcatggtcactgttggtgtatagaagagctactgatttgtgtacattaatctcgtatctggaaaatttgctgaattcttttatcagttctaagagctttctggaggagtccttagggttttcaaggtaaacaatcatattgtcataaaaaatgacagttttatttcctatttaccaatttggatgccttttattctttctcttgtctgactgctctggctaggacttccagtactatgttgaagaggagtggtgagagtgggcatccttgtgttgttccagttctgagagggaatgctttcaatttttccccattcggtattttgttggctgtgggtttgtcatagatggcttttattgcattaaggtatgtcccttgtatgccgatttcactgagagtttcaatcataaagcaatgttggattttgttgaatgctttttctgcatctattgaaatgatcatgtgatttttgtttttatttctgtttatgtggtgtgtcacatttattgacttgcatatgttaaaccattcctgcatccctggtatgaaacccacttgatcatggtggattacctttttgatatgttgttagattcggttagcaagtattttgttaaggattttagcatctaagttcatcaaggatattggtctgtagttttctttttttggttatgtcctttcctggttttggtattagggtgatgctggcttagtagaatgaattagggaggtttccttctttctatatcttgtggaatagtttcaaaaggattggtaccaattcttttttgaatgtctggtagaattctgctgtgaatccgtctggtcctgaacttttttttgttggtaatttttaaattaccatttcaatctcactgcttgttattggtctgttcagggtatctaattcctcctgacttaagctaggagggttgtatttttccaggaacttatctgtgtcctctaggttttctagtttatgtgtgtaaaggtgttcatagtagccttgaatgatctttcatatttcagtggtgtcagctgtaatatctcctgtttcatttcttagtgaggttatttggattttctctcttcttttcttggttaatcttgccttttatggcctatcatatggtctatcttggagaaagttccacgcgctgttgaatagaatgtgtattctgcggttgttggatgaaaatgttccctatatatctgttaagtccatttgttccaagatatagtttaaatccattgtttcttttttgactttctgtcttgatgacctgtctagtgctgtcagtggaatattgaagtcccccaatattattgtgttgctatctcatttcttaggtctattagtaattgtcttataaatttgggagccccagtgttaggtgcatatatgtttagaattgtgatattttcctgttggacaaggccttttactgttatataatgtccctctttgtctcttttaactactgttgctttaaagtttgttttgtctgatataagaatagctacccctgctcacttttggtgtccattttcatgaaatgcctttttccattcctttaagtttatgtcagttcttatgtgctatgtgagtctcctgaaggaagcagatagttggttggtgagttcttatccattctgcagttctgtatctcttaagtggagcatttaggccatttacattcaatgttagtattgaaatgtgaggtaccattgcattcatcatgatctttgttgcctgtgtactttggttttttgtttttttgtgtgtttgctttttaacttgtatttttgttttataggtcctgtgtgatttatgctttaaagaggctctgttttcacatgtttccaggatttgtttcaagatttagagcaacttttagcagttcttgtagtggtggcttggtaatggcaaattctctcagcatttgtttgtctgaaaagactgtgtcttttcttcatatatgatggttagtttccctggatacaaaattcttggctgataattgttttgtttgaggaggctgaagataagtccccaattgcttttagcctgtagggtttctgctgggaaatctgctgttaatctgataggtgtttctttataggttacctggtccttctgtctcatggctcttaagattctttccttcaccttaacattggataacctgatgacgaagtgcctaggcaaagatctttttgtgatgaatttcctgggtgttctttgtgcttcatgtgtttggatgtctaggtctctagcaaggccagagaagttttccttgattattcccccaaatatgttttccgagcttttagaattctcctcttcctcaggaacactgattatttttaggtttgattgtttaacataatcccagacttcttggaggctttgttcatattttattattcttttttctttgtctttgttagcttgggttaatttgaagacctagtcttcgagctctgaatttctttcttctacttgttcaattatattgctgagaccttccagagcatttcttattgttaaaagtgtgtccaaagtttcctgaatttttttttttctttaagctatctatttccttgaatatttctcccttcacttcttgtatcatattttggattttcttacattgggcttcgcctttctttggtccctccccaattagcttaataactaacctcctgaattatttttcgagtaaagcagggatttcttcttggatccattgctgatgaactagtgtgattttttgggtttgttgaagagccttgttttgtcatattaccagggttggttttctggtgccttctcatttgggtaggctctgtcagagggaaggtctagggccgaaggctgttgttcagattcttttttcccacagggtgttcccttgatgtagtactctcccccttttcctgtggatgtggcttcatgtgagccaaactgcagtgattgctctctcttctgggtctggccacccagagagtctgcctggctctgggctggtattggcacttgtctgcacagagtcctgtgataccaaccatctgtgggtctctcagccatggttaccagtgcctgttccggtggaggtggcggggtggggggtgcaatggactctgtgaggcttcttagcattgatggtttaatattctatttttgtgctggttggcttcctgccaggaggtggcactttccagagagcatcagctgtggtattatggggaggaaccagtggtgggtggggcctagaacaaccaagtttatataccctttgtcttccactaccagggtgggtaggaaaggaccatcagctgggagtggaactaggtgtgtctgagctcagactgtccttgggcgggtcttgctgcggctgctgttggggggtggaggtgagattcccaggtcaggggagttgtttacctaggaggattatggctgtctctgctgagtcatgcaggttgtcagggaagttgggggaaagggggcagtcacaggcctcacccaactcccatgcaaatgaaagggctggtctcactcccccagtgcacctcccaacaccctccagagcatttccaggctgagagcagtaagggcttgaaaacctgccccaggctgtatgcctcctagctttgaaagataagagcttggttcttcccctgcctgtggagtctgcacactgaatttgcaccctccttccagttctggccaggaggcttctcatctcgttcaaatggttacaaagttcagctagagatttccttctccctgtgtagttttaccctctgctcttctcccattggatccctggggtgccaggcaggaatggcctgctagggtacccagcgagctcccagggcctttctgctgcatcctctacccctgtattttgcttggctctccagattgactcagctccaggtaaagttggaaacttctcctgcaaacagaccttcggcttctccagtggggctgtgtgttcaggagaggagggtctccctctcccacttccgcaggtggggcactcgcagttttgggattgtctcctggttcctgcaggagcagtctgcttttttcagagggtctgtgggtcctctcaggatggctggtttgttttgcagtcgatctgatgctaaaattcacagtgcgaggtgccgcccactgctctgtccagagctgcaatctagtcctgcctcctgtctaccatgattgaccttaaaaactatccagcagtgttctgataacaatttgaattcatttacatgctgtcaacattattgctttaggatatattttgtttagctgccaagccacaacagtaacttctttattctttgcatcctttgctgagaataaaacctgttttgttataaatttacttatcttggggtatgaatgggctttggaatgagagagtcttgagtctaatcccactctgccatgtaaacttaaaattgttcccagcttaagttttctcatttgtaaaacagggtaacaagccttacattattgtggtattttgaaatcaagcatgttggggggctgacacaagtgctttgcaaacaataaatgccctgtgaaggataggtattaccccctgcagaaaaatgaaactggatccctatctctcattatatacaaaaaccaactcaagacagattaaagacttaaatgtaagacctgaaatgataaaaatactagaagaaaacctagggaaaactcctgtggacattgctgtaggcaaggaactcatgactaagacctcaaaggcagaagcaacaaaaacaaaaatagacaaatgagctttaagtaaactaaaaaggttttccacagcaaaagaagtgatcaccataatgaacagacaaccacagaatgagagaaagtatttgcaaactacgcatcccacaggagactaatatccagaatttataaggaagtcaacttaacaataacaaaaactaaccctattaaaaggtgggcaaaggacatgaatagacatttttcaaaagcagacatacaaatggacaacaagcatacaaaaaatattcaactcactaatcataagagaaatgcaaattaaaaccacaatgagatatcatcttataccagtcagaatggctattgttaaaagtaaaacaaacaaaacaaaacagatgttggtgaggatgcagagaaaggggaatgcttatacactattggtaggaatgtaaatgagtgcaacctctatggaaatcagtatggggatttcttaaagaactaaaattagaaccatcattcaatctagcaatcccactatggtgtatctactcaaaggaaaataaatcattatatcaaaaagatacctgcatttttatacttatcacagcacaatattcacaatagcaaagatatagaatcaacctaagtgtccattaacatatgatttaataaagaaaaggtagtatctatacacaatggaatactattcagctataaaaaagaatgaaataatctcttttgtagcgacatggatagaactagaggccattgtcttaagctaaacaactcagacacagaaagacaaataccttgtgtccttacttataagtgagacctaaataatgtgtatatatggacgtagaatttagaatgatatgcaatggacactaggaagtgtgaggggatgggaggagggtggatgactgggagttacttaatgggtacattatttgggtgatggataccctaaaaaccctgatttcaccactatgcatgcagtccatgtatataataaaattgcacttatacctcatacatttatacaaatttttaaaaaggcaaatataagcccattttcttttaaaaaaagtaaaataaaaggtggatattattgttagatgcgattattgttagatgctactttctgacttattcccagttcttagattgggggaactcgatttttgactctacagttcacagttcaacctttggatttctgaaaaaaaaaaaaaaaaaaaaaaaaaaaaagaattgagaagcattttgtagaacagattggagtttatctttaaataatcaaattaagcctttgtaatgggaacaagactaaattcagctctctaaattagccacaggaaagaaacaagaaggacaagtgatattattttaggtgctcagatatttgtataggctttgcttgctcacataaggaattgaggagagtatatcagcactgagctggtgctgtagtcccagctactggggagactgaggtaggaagatcactggagtccagaagttctgggctgtagtgtgctatcccttttgggtgtccacactgtttggcatcaatatactgacctcccaggagtgggggactactagtttgcctaatgaggggtgaagcagcccaggtctgaaatagaagaggtcaaaactcccatgctgatctgtatatcagcaatgtatacagtcttgaggaatcacacaggacagaaagtacctgaatcttaatctcagatatgtctaaaagggattgttaattttctgctgtgtgtcaggccctatctagtcatggtgtgaaagacaaagatgaagaaggcaaggctcttatgcaattgatggatagctccaggaaagacatcctggtgagcaggactgtgtgaaatagggaagcagctcctctaaattctttttttttttttttttttgagacggagtctcaccctgttgcccaggctggagtgcagtggtgcaatctcggctcactgcaacctctgcctcccgggttcaaatgattctcctgcctcagcctcccaagtagctgggattacagacgcccgccaccatgcccagccaatttttgtatttttagtagagacagggttttactatgttggccaggctggtctcgaccttgtgatctgcctgcctcagcctcccaaagtgctgggagtacaggcgtgagccaccgcgcctggcctctacattcttcatattgggactgtattagttagggttctccagagaaacagagctaacaggatgtatatatagaaagaggcttattgatggctcacatgattgtggaagcttgacaaatccaaaatcttcagggtgggccagcaggctggagacctgagaaagagttgcagttttagtccgaaggtgatccgttggcagaattccctctgcctcaggggcggtgagtcattttctgttaagacctttaattgattggatgaggctcacccatattatggagggtaagctgttttactccaagtcaactgatttaatatcaatcacatctaaaaaacactttcacagaaacatactatttgatcaaatatctgagtacagtggtctaggcaagttgacacataaaactatcacaggaacttgtttttggaatctgccttgtaccccatagcagattcaatcttatatagtatcccagccctaggccttaagcctccatcacttagttccatcctttgtttatgactgtgcttcaagcctactttgattgatggcactgctaagaccgtgtgcctttctgatcataccattagcttcagtcttgtcaacatttttatctgttgcagactgctgcctgggcctggcctcttcctataaccctaagctccactttgatcccagcctacttcagtcttctgcacagttgatttggcctacagactgctgaactgaggcaggatactcatagctcttagggggccattagtgtcctgacaatgtcatatcttccccttagctttgtatactatctagaagttacgtggcttcctgggattcttattacaaacttcagatccttcttgtttagaggtcatttattgtgaggctgctcctgccctctttgttctctcatcatgttttgtagggaggagaaattattaaatatactgccattttttaaataattgaatgcatatggtatttatgacctgcataccagtactgttatttcgctccattatgacttttattctcagaggcctatggttttcaaatgccactgttgtgaatagctgtctgtagaattgctaccatggtgcttgaatccttatacactagccattctacctgataccgtattccagtgagcactgtgcttgctgcccagcatttcagattggatctgatttcctgggattaaattccagacgttattttccaatttgtcatctgcctgtttgggggaagtttctttcaggttgtaggtcagatgggtgttcactgacatctttagatcctatttattgggtcttcttgttggtatttttttctataatggcagaataatttgttttcctcttcagaataattgcaaggtgaaaacaaataattctagcttaaaaatgatatcaaatgacttcattggttatattttagtagcttggaatattacagaaaagaagtacatattttcttctgctttgaaaggggaaatttaaatcaggatacttttagtctgtaaacatgactactttttaaaaacatatatgagaaatattggaacaataaaatctgattcatctaatagctttccttgatactttttatttttaactatgatagatatgtattaacatgtagttattctctttgaaaaagtatattcattttctaaaatgtacttagcttttcaaatatgattctcacagtgtcctgtgtattgttaaaaataattactgaaacagtttcactttgaagtacagtacttgaaatcttcagatcaatatcgccttttaaacctttaatacaaccttatgccaatcaagtcgcaagtgtagtttgctaaggtagaaacttcttgatttcagtacaattataactgaccaatctatatttcaaaatagaggcttttataatgagattccatatggatattgatttcaattttctgtgttaatataaaagtgcaagtggtctcaagcttaggtgatccaaaatatttttttaaggtagttgtttgaaacttagaatgttttttctaaagaactagtgttatacatgacaggtttccaggcccacccacaaaaggctgctcaaaccatagtgtaagctgaaaatagtgtcctaatggtggctgtaacttcttacttccctgaaaccactctaagtcctgattttctttgtgttcctagtatttgagtgtgagagggaagttggtagaagcaggtaggttgtatctggttagggtaaaagtgagaaaaagggttgttgatcagttcaggtggggtttaggtatagaagcttcatgaattagtgagttgctaaatatcagggaatgtaaagggcaaagttttggcctctggggtctagcaatagcaggaatggtgcccctgtctttagcagaggacctcagtgtttccatagggtctgtgatggcgcagtaagggtgtggcccttagcagaggtattggcactggtagctgtttgtatacataggattttcgcaactgtttataaggattgaatgctggtgagaggtgacagcatgctggcagtcctcacagccttcgctcgctctcggcgcctcctctgcctgggctcccactttggcggcacttgaggagcacttcagcccaccgctgcactgtgtgagcccctttctgggctggccaagactggagccggctccctcagcttgcagggagatgtgtagggaggcgcgagcgggaaccggggctgcgcgcggcgcttgcgggccagctggagttccgggtgggcgtgggcttggcgggccgcgcactcggagcagccggccggccctgccagcccgggcaatgaggggcttagcacccgggccagcggctgcggagggtgtactgggtcccccagcagtgccagcccaccggcgctgtgctcgatttctcgccgggccttagctgccttcccgcggggcagggctcgggacctgcagcccgccatgcctgagcctcccacccactccgtgggctcctgtgcggccaagcctccccgatgagcgccgccccctgctccacggcgcccagtcccatcgaccacccaagggctgaggagtgcgggcgcacagcgcgggactggcaggcatctccacctgcagccccagtgcaggatccactgggcgaagccagctgggctcctgagtctggtgaggacgtggagaacctttatgtctagctcagggattgtaaatacaccaattggcactctgtatctagctcaaggtttgtaaacacaccaatcagcaccctgtgtctagctcagggtttgtgaatgcaccaatctatactctgtatctagctactctggtggggccttggagaacctttgtgtctagctcagggattgtaaaggcaccaatcagcgccctgtggaagcagaccacttggctctaccaatcagcaggatgtgggtggggccagataagagaataaaagcaggctgccggagccagcagtggcaacaggctcgggtcccctttcacatggtggaagctttgttcttttgctctttgcaataaatcttggtactgttctctctttgggtccacgctacctttatgagatgtaacactcaccacaaaggtctgcagcttcactcctgaagccagcgagaccacgcacccaccgggaggaacgaacaactccagatgcgccgccttaagagctgtaacactcgccgccaaggtctgcagcttcactcctgagccagcgagaccatgcacccaccagaaggaagaaactccgaacgcatctgaacatcagaaggaacaaactccggacacgctgcctttaagaactgtaacaccgcgagggtccgcggcttcattcttgaagtcagtgagaccaaggacccaccaattccggatacactgggatttagatgccaactttactttttttagggtctgctgggctgagcctttaaaatttccctttgcttttagaaattaatttatggaccatacttgtatttgacccattatcccaagaaaattcttaaagcaaacataaaatacatggtccaggatttaatctagttgtcatatcattttaggttttcttaatctgtaacagctgttcagtctctctttgtctttcatgacaataccattttaaaaaattaatagactttatttttaagagcaattttaggtttacagtacaattgggcaagataatagtattatgtcaatgtaaattttctgattttgatagttatacatggttctgtaaaaaactggcttgtttttaagaaataaactgaagtgcttagggaaaagagcatcattctgcaatttactcttaaaaactatatatatagttttttctatgtatatatatagagagagagagagagagagagtgtgtgtgtgcgtgtgtagacaataaagcaagtgaagtaaaatgttaacaattagggaatctggaagtctgtgttctatatatctttatatccaataattttacttaaaataatgttttaaggaaatggtcataaatatttttctttttttttttttttttgagatggagtctctctctgtcacccaggctggagtgcagtggcgtgatctcggctcactgcaagctccatctcccgggttcacgccattctcctgcctcagcctcccgagtagctgggactacgggcatgtgccaccatgcccagctaatttttgtattttagtatagtcttaactgtaatagcaaaaggttagaaaagacctaaatggctatcaatgaagaattgcttacataagttagatttttacttaatggaatattatgtatgtatccatgaaaatgatgtaaaaacgtatagtccttgatttaggaagatgtctgaaatattttcttaaataaaaattgtcacagaaaaaaagacattaatttcggccagctgaggtggctcatgcctgtaatcccagcactttcagaggccaacgggtggtttacttgaggccaggagttcgagtttagcctgggcaacatggcgaaaccccatctctactaaaaataacaaaaattagctgggtgtggtggcacacgcccataatcccagctactcaggaggttgaggcacaagaattgcttgaacctgggaggcagcagaggttgcagtgagccaggatcatgccacagcacaccagactctgtctcaaaaaaaaaaaaaagaaaagaaaaaagacattaaatgcaaagaacagtgtcagtattgctaggatgtctgttctttccaactatatgttcaacatatcccaaaagtaagttgcaaaactataaaactttaggagataacataggacaaaatataggtgatcgtagtttgctgatgagcttcttttagatacaacaccaaaaacactgtacatgagagaagaaattggcaagtgagacttcattacataaaaaatttctgctttgtgaaagacactgttaagagaacgaaaagacaagccacaggctgggagaaaactttgtaaatatatatccatctgataaaagactggtatctaaaatatacaaataattcttaaaacccaacaataagaaaacaactcaagtaaaaagtaagggaaagatttgaacagatacttcactaaataagatgtacagatggcaaataagcacatgaaaagatgctcagtattatatgtcattaaagaattgcaagttaaaataacaattagctatcataatagctaaacccaaaactctgataacattgaatgctgacaaggacgtggaacaacagtaactctcattcattgctggtgggaatgcaaaatggtacagctgctttggaagacaggttggtaggttcttacaaagctaaacttagtcttactgtatgatccagcacacatgcttctagtatttaccctgagttgaagactgtccacacaaaaacttttacatgaatatttttagctactttatcataattggaccaaagtagaagcaaccaagatgtccttcagtggaaaaatgcatagacaaactatggtacacagatataatggaatacagatataatgcggagacactgcagttttggtttcagaccaccacaataaattgagtatagcaataaagtgagtcacagaaattgtttgctttcctaatgcaaataaaattatgtttatactatactttagtctattatttgatagcattatatctaaaaacatgtacataccttaatttaaaaatacttaattgctaaatattgctaatgatcatctgagtcttcagtgagttacagtctttttgctgatagagggtcttggctcattgttgatcagggtgatggttgctgaaggttagggtggctgtggcaatttcttgaagtaagacaacagggaagtttggtgtggttaacttatcctttcaatttctctgtagcacgggatgctgtttgatagcattgtacacacagtagaatttctttcaaaattgggttcagtcctctcaaacagtaccgctgctttatcaactaaatttgtgggatattctaatcctttgtagtcatttcaacagtctacatagcattttcaaaaggagtagtttccatctcaagaaaccactttctttgctcatccttaagaagtaactcctcatctgttcaagttttgttgtgagactgcagcaatttagttatgtctttagggttcacttctaattctagttctcttgctatttttaccacatctgcagtgatttccttcactgaagtcttgaagccctcaaattcatccaccaggcttggaatcaacttcttccaaactctcattcatgtttatatatatatatatatatatataacacaggctgggcctatatatatatatatatatatatatatatatgggcccagcctatgttataatttgacctccttttacaaatcatgaatgttcttaatggcatctagaatggtgaatccttttaagaaggtttagaattactatctgtggcagttatagccctattaaatgtatttcttacaagaaggcttgaaagttgaaattagtccttgatccatggactactgaagggatgttgtgttagcaggtgtgaaaaaaacattcatcttgtagatcagagcttttgggtggccaggagcattgtcaatgagcagtaatattttgaaaggaatcttttttttttttctgagcagtaagtctcaatagtaatcttaaaatattcagtagaccatgttgtaaacaaatgtgctgtcatccaagctttgttgttccatttatagagcacaggcagagtgcatttagcatcattctttttttttcttttttttttaaattatactttaagttttagggtacatgtgcacaatgtgcaggttagttacatatgtatacatgtgccatgttggtgtgctgcacccattaactcgtcatttaacattaggtatatctcctaatgctatccctccccactgcccccaccccaaaacaggccccagagtgtgatgttccccttcctgtgtccatgtgttctcattgttcaattcccacctatgagtgagaatgtgcggtgtttggtttttttgtccttgcgatagtttgctgagaatgatggtttccagcttcatccatgtccccacaaaggacatgaactcatccttttttatggctgcatagtattccatggtgtatatgtgccacattttcttaatccagtctatcattgttggacatttgggttggttccaagtctttgctattgtgagtagtgccgcaataaacatacgtgtgcatgtgtctttatagcagcatgatttataatcctttgggtatatacccagtaatgggatggctgggttaaatggtctttctagttctagatccctgaggaatcgccacactgacttccacaatggttgaactagtttacagtcccatcaacagtgtaaaagtgttcctgtttctccacatcctctccagcccctgttgtttcctgactttttaatgattgccattctaactggtgtgagatggtatctcattgtggttttgatttgcatttctctgatggccagtgatgatgagcattttttcatgtgtcttttggctgcataaatgtcttcctttgagaagtgtctgttcatgtccttctcccacttgttgatggggttgtttgttttttttcttgtaaatttgtttgagttcattgtagattctggatgttagccctttgtcagatgagtagattgcaaaaattttctcccattctataggttgcctgttcactctgatggtagtttcttttgctgtgcagaagctcttgaatttaattagatcccatttgtcaattttggcttttgttgccattgcttttggtgttttagacatgaagtccttgcccagcctattcttaatggccctacgatatttagaatgttaaacaagcattggcctcaaactaaagttacaagctgctgtagctcttaacaagagagttagcctgtcttttgactcttcgaagctaagtattgacttctcccctctggctatgaaaatcccagatagtgtcatcttccaaaataaggctgttttgcctacacaggaaatctcttgtttagtatagccaccttcatcagttatcttagctagatctagataacttgctgaaccttctacatcagcacttgctacttcatctttcacttttatgttatggagatggcttctttccttaaacctcaggaacctacctccgctagctcccagcttttcttctgcagcttcctcacctctgtcagccttcatagaattgaagagacttcgggctttgttctggattaggctttggtttaagggaatattgtggttggtttgatgttctatccagattgctcaaattttctccacatcagcaatagggctgttgcactttcttatcaaatgtgtgttcactgaagtggcactttcagtttccttcaagaaattttcctttgcatttacaattcagccaactgtttggcacatgaggcctagctttcagcttgtcttggcttttgacgtgtcctcctcactaagcttaatcatttctagcttttgatcgaaagtgagacacatgtgactctttctttcagttgaacacttagaggccattgtaggtttattaattggcctaattccaatcttgttgtgtctcagggaatagggaggctggaggagagggagagatatggataatggctggtcagtggagcagtcagagcacacacatttatagattaagttcattgtcttatatgggtgtggttcatggtgccccaagacaattacagttataacatcaaagatcactgatcacagatcaccataagagataaaataataatggaaatgtctgaaatgtaagaatcaccaaaacctgacacagagacactaagtgagcacatccgcttgggaaaatggtaccgatagatgtgcttgatgcagcgttgccacagaccttcaatttgtaaaacattcaatatctgtgaagcacaataagtaaagcataataaaatgaggtatgcctgacttatttagtgatataaagaaatgagctggccgggcgcggtggctcacgcctgtaatcccagcactttgggaggccaaggtgggaggatcacgaggtcaggagattgagactgtcctggctaacatggtgaaaccccgtctctactaaaaaaaaaaaaaattagccaggtggggtgtggtggcgggtgcctgtagtcccagctactcgggaggctgaggcaggagaatggcctgaacccgggaggcagagcttgcagtgagccgagattgtgccactgcactcccgcctgggcgacagagcgagactccgtctcacaaaaaaaaaaaaaaagaaaagaaaagaaaagaaatgaactaacaagtcatgaaaagacatggaggtaccttaaatgcctattactaagtgaaagatagccagtcttaaaagcctttatatactgcctgatgccaactatatgacattatggaaaaggcaaaactatagagacaataaaaagatcagtggttgataggagttgagtaggaggagtgaataggttgagcatatggcagttttagggccgtgaaactattctgtatgatactctaaaggtaaatatatgatattacggatttgcaaaacccgcagagctgtacaagaatgaaccctcatgtaatctctggactttaataaataataatgtatcaatattggtaaatcagttgtaacaaatgtaccacagtgatgcaagatgttaataatagggccaactttggacaggggagagagggtatatggggactctgtactttatgaccaatttttgtcaaaacttaaaactgcactactaaaaataaaagcaataataaaactcactaaaaatgcatcaatttaaaaaaagttaaaaaaccatgtattctattgattgttcatatatccttttccataattctccagtgacttaatatttgaatttaaacaatttaaaaatgatattcatataattccaaggttttccacacattttttatggactctcaattgttcttgggtgtaccttagttattcttagttcatctgttattttcctgtaagtacatatttcctgaaggtatatggttatactttgaaacaaaattagaaatgatcttacattaaatattatcctatttaaactattttaatagttttagatgatttaagttctcagcatgctttttctatcttctgtgctatatatgctctatttttatatcctttgtttctttgcagatgaaatggtttctattgttctagttctttctgtcttttgccaatagcccacctcatatctctgtacatgcacacccatcacaaacagacagacacacacatgcatacagacttttgaaccttagagttaagctgcattcttgtcaaaaagatctagcactccaagagtggatgcctctccctttctttgggagatcagcattactcatcacctcaaatattcttgcttcactatttgctcattgttttggatatacagagcacttaaatatttgctattttagtgcatcattaatgaaccgtttattatgttttcaaagtcaaatatgggtcaaagtaatttttttaactaagttttactcttcaggttcttttttaatgtgaaaaaaagaggcccacactgtttctgtctatttataggtggtaattggaagttggtacaagagtagtctaaacagaggagtcatattgctccaggcagattaaaaaaggtatctagttatataagcctacataaagccacatctccagactaatattttcaaacgtgaaggggataaaatttatattatgaacagctgtagatttaactttgtaaagcctaaaattatagtagaaaatatttcaattatagttcttaaaatatgaaagagatgttgattgtacattgaaatattttgcataatgacatctatttttcacacacatgcatacatacacacacattcccattttgtagattataaaacagaggcacacagtagttaagaggcttgtataagcttacacagctagcagggagaccatgattcaaacatcaggcagtagaactcctgagtaccctctctgaactgctaagctatgttacctctcatcttaactaacatgactcattttttgcccttaaaatgccttgaaaaatactatgaagaaatacctcatccagctgtagaggaacaaccaactacatttatttttagaaatgataaaggaattgttttgctctgtacatagacttctacaactagagcagttgcataacgtggtctgtgtagattacacttttttcacgattcatttaactacttgaatttgatatcatttcctttcaaactgaagcacatctgatgcagatttactgggacattcgcactccattttggttttaaaagttgcagacctcatttacaagagcatgaacaacatagctatttgaaattatcccatcttttataaggtttcacttttcttctggaaaggcaaataatacgtggaaaaacatacttaatagtattactgtttttttaattataactgacatactgctcatggactagttgccagttaacccactgatgtgtaaatgtcctaaactgagaggcttgactgaagaaaaataaccaagttacttagcctatatgacgaagtttcctaaaaacccctccatacacatttggaaatattcatattatatgtttttttaaatctctaaatgggaaattcatgtgtatttttgaaatcaaatccagactgctttgatttgcttgtgcttacgtcctataatttcaatgtcaagatgcaaaattgtactagtcattccttggagtggttaaaaatgaaacagtagtttgatttcatattcatgatcgattaagtgagaaatcaactgtgcagtagaacttttccagtttatgtaattcttgaagctttatgagctttagaatcaaaacgctttcatgatctttgcttaagacattatagtagtgttgcttagaagacaaagcaaataaaaatacttttatactcttcgcttaataccttgtagtagtcttgcttacttaaaaaaaaagcaaaaaaaactacatctgccaccttgcatttaatatttagaaaatacgaaaatgaaagaatcaaattaacaaacatttatttactcaacataaataattaacatttttggttttttgcttaatatattttattaaaaatttgacgtcaaagataaggttgaagtccactctgttacttctttagttccagcaaccgccctctcttttcagaggctactgcatttatgaatttggtgtatattcatttagttcatacttttgtccattgcctctactagtttaatgctttaaattcaatctgccttcttgtatcaaccatcatgtttagcattttagatacaccatattttaaactatttccaatcaaaatgtcagttattaaaaaaatcagtgtttattataaatttctatgataaatatttttcttggatctaattccttctttattgccaaaatttgtttttaatgagtgtaacaaactgttaatttttgtatgtctgaaaatttctttattttatccttactcttcaataacttagattcaagtatagaatcctgggtatagaattcctgctggatggttagtcttcttcaataattagaagataatatttcataatctagtagcatttgttgttgctgatgagaagtgttagtataattgctacctctataacaagctctcatatctctctgatagctttaaatattttctttttgtctttgttgttatggaatttcattacaattatgaatacctgtcgatttatgtgtgtatatataaatacaatctcccatttcttcaatctgatgattcttttttttgttagagaatatcagccacatactttgtatatattatcatctctgcacattctctttttttcctcacttagtgggactcctatgagacaaatgattcatcttttcattcttatacctcaaatcaatttctctttcatagtttttatcttttttctttccatattgtgtatctgcctcatatatctctttagctaagtctaatttatagttctattaattctttatttatttattttattattattattatactttaagttttagggtacatgtgcacagtgtgcaggttagttacatatgtatacatgtgccatgctggtgtgctgcacccattaacttgtcatttagcattaggtatatctcctaatgctatccctctcccctcccccccaccccaaaacaggccccagagtgtgatgttcccctttctgtgtccatgtgttctcattgttcaattcccacctatgagtgagaacgtgcggtgtttggtttttttgtccttgcgataatttgctgagaatgatggtttccagcttcatccatgtccccacaaaggacatgaactcatccttttttatggctgcatagtattccatggtgtatatgtgccacattttcttaatccagtctatcattgttggacctttgggttggttccaagtctttgctattgtgaatagtgccacaataaacatacgtgtgcatgtgtctttatagcagcatgatttataatcctttgtgtatatacccagtaatgggatggctgggtcaaatggtctttctagttctagatccctgaggaattgccacactgacttccacaatggttgaactagtttacagtcccaccaacagtgcaaaagtattcctatttcaaaagctaatccaccacgatcttgtaggctgtatccctgggatgcaaagttcatttaacaaatgcaaatcaataaatgttatttattacataaacagaactcaaaagaaaaaaacacatgattatattattatcttaattaatgtagaaaaaccttttaatgaaattcaacatccattcaggttagaaatactcaacacaccaggcgttgaaggaacataattcaaaataataagaactatgtatgaaaaacccacaaacaacattttactaatgagcaaaagctgcaagcatcccccttgaaaattggaacaagacaaggatgcccattctcaccactcctattcaacatagtattggaagtcctggccagaacagtcaggcaagagaaagatataaaaggcatccacattggaagagaggatgtcaaactattcctttttgcagacaatatcattctattcctggaaaatcccacagtctctacccaaaagctccttgagctgataaacgacttcagcaatcaggatacaaaatcagtgtacaaaaatcagcagccttctgaccaggcccagtggctcatgcctgtaatcccagcactttgggaggccgaggcgggcggatcattaggtcaggagttcaagaccagcctggccaatatggtaaaacctcgtctctaataaaaatacaaaaattagccagacacagtggcatgaacctgtagtcccagctacttgagaggctgaggcaggagaatcgcttgaacctgggaggcagaggttgcagtgagccaagattgcgccactgcactccagcctgggcgacagagtgagactccgtctcaaaaaaaaaaaaaaaaaaaaaaaaaaaatcagcagccttcctatacaccagcaacatccaagttgggaccccaatgaagaatacaatctcattctcaataggcaaaagagaataaagtacttaggaatacagttaactatagaggttaaaggtctctacagtgagaattacaaaacactgctgaaagaaatcagagataacagaaacaaatggaaaaacatttcatactcatggataggaagaatcaatattgttaacatggctgtactgcccaaagcaatttacagattcaatgctattaatatcaagttaccaatgacattcttcaacgaattagagaaactgttttaaaattcatatggaacaacaacaaaaagcttcaataaccaaggcaatcctaagcaaaaagaaatgctggagacattttctacctatctttaaactattctacaaggctggagtaactgaaacggcatgatactgtcacagacacacagacaaatggagcagaatagagagacctgaaataatgccatatacctacaaccatctgatcatcaaaaatgttgacaaaaacaaccaatggagaaaggactcattcaataaatggtggatatgcactagaccccttccttacaccatatacaaaaatcaactcaagatggattaaagtcttaaatgtaaaacctgaaactataaaaaccatggaaggtaatctaggaaataccattctggacacaggccctaaagatttcatgacgtagatgccaaaagcggttgcaataaaaacaaaaattgacaaatgggacctaattaaactaaagagcttctgcagagcaaaagaaactattagcacagtaaagagactacctacagaatgggagaaaatatttgtaagctgcacatctgacaaggctcttatatccggaatctataaagaacttaaacaaattaacaagcaaatgaaccccaaacaacttcatgaaaaagtgggcaatggacgtgaataaatacttttctaaagaagacttacatgtggttaagaagaacatgaaaaaatgctcaacatcacgaatcattagagaaacaataatcaacaaccacaatgagataccatcttataccagtcagaatggctgtcattaaaaagtcaaaaaaataacacatgctggcaaggttgtagagtaaagggaatgcttatacgctactggtgggaatgtaaattagttcagccattgtgaaaagcagtttaatgatttccaaaataacttaaaacagaactatgattcaactcagcaattccattattgggtatatactgaaaaggaaaataaatcattatgcaaaaaagaaaatgcacttgtatgtttatttcagtactctccataattgcaaagacatggaattaacataaatgcccatcagtggtagactggatacagaaaacatggtacatatacactatggaatactatacagccccccaaaatggatgagatcatgtcctttgcagcaatatggatggagctggagttcagtatcctaagcaaagtaacataggaacagaagaccaaatactgcgtgttctcacttataagtgggagctaaacactgaatagacatggacacaaagaaaagaacaaaagatacccaggcctacttgagggcagaaggagggaggacatgaggatcaaaagctacttaagaggtactatgcctattacctgggtgactgaataatcagtacactaaatgctcatgacatgcaacttacctatatgataaacctgcacatgtatccagaacctaaaataaaagttttggctgggcgtggcggctcttgcctgtaatctcagcactttgggaggccgaggtgggtggatcatgaggtcaggaattcaagatcagcctgaccaacatggtgaaaccccctctctactaaaaatacaaaaaatagctgggtgtggtggcacgtgcctgtaatcccagctattcaggagaatcacctgaacccgggaggcggaggttgcagtgagccgagattgcatcactgcacttcagcctgggtgacagagtgagactccgtctcaaaaaaaaaaagtttttaagaaataaatacaaaagaacacgaagaagtatttgctaacgcatatttttcttttggagcttagtatattaataggtatgtgatgcatattaactagcataatctgagatatttataaaggaaaatatcatcttgctaagtggttatatctcagccaaaaataaatttacatttgttataaaaactgaaaatttatgtggtttatgtgtagaaggcttatagaatcagtatgattttcattcagattggtgtgtgattttttttatcagtagaaaattttatgataacaacatgaaccactgctgggaattcaatggaccgtaaacataggcacataacagacatggaaacacgtacattgtgaaggataagtagatatttatcaaattatatatatatgatacatatacatataagcatatatgtatatatatgtaaaacattgtaaccatggccaccacctttagtaaaggtacatggtgatatgagtgcttataatagggaattaccttgtcagggaagttaaggaaggctttcctgaacaactgatgcttgaactccaacctgtgggatgatgtgttagaactggctagtgagtgggaatatccttacaaggaggggccctgtagcagaaggaaaagcagatgaaaatattgtcttcatacttagaatttaattttaaattttactgatgtttgtgttaatatccttgtctaatactattcttttacataagctttaatggagaccacccaattggttccttcagaaaatgtatgttaattaatgctagggacctatagtagatgtcataaaccttatgattaaacattacaactgtgtaaaattacatcttagtaacctcagtcatttgtattatattaaaatgagaaaatgcacagtgatagaagtcagattaaaggtcatgtaactaaaattgtatgctgaatgttgaggaaagaaaatttggatgttctctgttcatttgggttattcaaaataacatgtagtcctgcatacatttaaaaaattaaattagacaatttatcagttgtctaatttaaaatgtttggattcatcttcctatctgataacaattttttgtttttatattcagtactttgaaaaatcacagacttcacgttaacacttaagcattctaaaaaggcacaaaagcatgtgaatatagaatttaagttttgaggattgttcttgtcatttcctgcacacacagtatttgaaaaatgcatatgaccttgcatttaggtaatattagatcagaatgatctttccacatagaatattcatatgccagcagaagtatacatatctactttagagatagtaaacataggtcaaatagtgactgtggaccacatatattcacagcataaagaaattctcacattgaggaaattttatttatttgaatttttaaattgttccattggatgacagataacatttaggtgttaattacccaattattttcctttaaaagtaataaatgtatgtaatttctgtgaaaaggaaaaccagaaaacaggcatctgtttattctcatgtactgctaacttaaattttatgtaatttcaaagtccaaagccaaattatacaccttttctattgcaagcaaataaaaacaatgtaaaaattactttaaattcaagaaacacgagcttatacagttttcattatgatcacatccctaatgttcagagcctttcagaaaaaaggattttcatccattattctaaactattttattaatttgttaaattaaacagatactatcacgtaaaagtaacctcttcccatcttgttttcactaattactttcaccaagatcataataccttcttaaactgaagaaactattcatgtccccaaatacagtgcattggccttcacacacagttattgtatgttttggctcatcatgggccctctttggagatatgcttgaggactcccctttacctctaatgtctacagattcagcttttcagttcattgtgttaactgagttttacatacagactataaactgtctgctgaatctattgagataaaatttgtcagcttttgtgctcttttgcatagggtgaatactaatcttcatattcttatacatttagtttgaaacaaagtgaaattaactggtagtttaatacttcattgccttatgcctttttagctgaccatttgactgtttctctccagtcttgctttttcatctacaagtttactacaaagactctacaaatggttaatttgattgaaaatatctgcctaaactatgtcagtaaagcatttttccccttttttggctagatgccattattccatatatataattatttcattattttctcttctttatatcagattaagattcatgatacacattcttgtattgcctgtacggaaaacacagctccgttattcactttggctaagagccccttgggatttctgacattgggtaaattatagatatagtagacaaactgttaactcaggagtagtgaagaacttaactctttaatgggtagcttatcccaattcaccgctttcatgggaaaccaaggctgttttgaacaacatatgatagaaagtggcaagacatattctgtcatttgacacctgacaatatattatatatctcttttccttagtgtacatgttaggaaaattagcaagcatttataagctcatggaaactctgaaattccatataagttgttttatcaagtcgtagcagtcagttctatcacagcatatgctagacagggccagggcaaaaactacatctacctagacatgttgctggctacacatcttattgaagaccaaattagacagtaaggaggtggtgagtccttactggaacatctaaagataatcatcaaagacatgtactgaatattgttatgtctaggcttctttctaagtgcattttaggtgccagctcatttacttttcacagttctttgaaatactgatattgtctccattttgtagctggggaaactgagtcagagagaaaggttaggaagcattgctcaaggtaacatagaagaatgacagagctaggatttgattgcagatattctggcccatggcacctcttaacctttgtgttatgttgcttctcaggctgacagtgagctcagacgctggaatgttggtcaaaatgaggggacttgaaagtgaacttcaaaattatccagttattttctggggtgatgctaaaaaaaaaaacccatattcagtagtgagcaaaagaggtgtcatgaagaatgtttatttagtggtcagtatgtagatggccaactctagaaggaggtgtgacattgtggtgtccaggctgcatgttatgaatagatttggaacctggcatgaagatccatagcagcccatgggtggatctatacagaacaaaggccctaacccaagaactagtatgtcctttttctggcctccttttaaaacaacttcttggtatgggtatataatgtgggcagaggtgttctgttctctaaagcaggtacaaatgatggccgctgagcgctggagcctccagggccatcacatttttaacagataaattacttaaagcttgaataaatggaatcttgtccatgctgtgatattacttggctctttgtgggtcctcagtaaacatgaaataaccctgaccttttaggaaaagattaatctggttactagccgtaagtgttaatgtaatattcttgtagcaaataaaaccctaagcacacagttgttgtttggtaaacattttgtttattgagcctgattttcctgctttcagccatagagaaatttaagcttcatatattattctttcatgggtaaattgtacctgctttttgagggtgagtagactgaaactaagactacggaagctaacagtttcatatgcctaggccgggcgtagtggctcatgcctgtaatcccagcactttgggaggctgaggtgggcagatcatgaggtcaggagatcgagaccatcctggctaacaaggtgaaaccccgtctctactaaaaatacacaaatcagccgggcgtggtggcgggcacctgtagtcccagctacttgggaggctgaggtaggagaatggcgtgaacctgggaggtggagcttgcagtgagccgagattgtgccactgcactccagcctgggtgacagagctagacttcgtctcaaaaaaaaaaaaaaaaaattcgtatgcttttgctaggcattataacatttaatcctcacatcaaccatggaaattaaaatatattcattcccattcttcagtggagaaacttgaagctcagagaggatgagtaacttgcacagagttgcatagttagtaagcattaaatccagcatagaactcaggtctgaggaactcccaatccattgcttatgttacttcatccacaagtattgtgaaatatacaactttaacatttcaaagagcagaattaaagaatctgccagcttccttttgaataggagaggggtattccaaggtcattagagaactggcctggagctcttaatgctataactcctaccaacactaaaggagagagtgggatcattgtcctgttcccattgccatcacctctacccctaaagcatgcagacatactttatccagagagttgaaaattcacagacaccattcctctcattccttccaagctgctgtggcttagatccaagcaagctccccatgtttcccttaattccaagggctattatctcaggttctgcacatcttacaaagtagatgtagtattgcaagtattgttttatctcaggctaacctatccatttaaagctctggacagtcatgttggtatagtttatgaatgtaaaattcttccttaaacataaattctagcttgaaattattcctaaccaccatctactccaaggccacatgaaattaatcttttacatatgatttttctggaaagtaagtttttgcttctacctgaaggagtacatctttatctgttcagggctcattaatgtttcctctaagatcccacagcagccatttgtaacacttcatggtgcttctcatgcaggcaggcatggatttgctctgaggacaatcaggatatcatcatcatcttcattgtagtgacttctatccctttctgtagtactttgatgtagtattggagtattagatcaggataatacgggatgaaatcctcccaaaataaatcatgcttgactctccgccgaggaaattcctccctctatttaataacggagaaaaatccagtcatctctgagtctagctcaagtatctccattgtgtgaagcttttcctaattcctcatttaaattagtctgtttttcctcttctttgtatagactacaccatgctgcctcctagttctgcttctgattccttttctaggtagtctcaaccttccggaatgagagatattaaggatacaagggtgaaacaggtagaagaagatgtgattttataatttcctttatttactctggttcttaccaaacaacaggtttatcagaatcagaatttttgtagcattcagacccagtttaaccctttttaaaatataacaaacttctttatcctgttgtaaaaacccctcccaaactcttattcagccttccctcaaggtgaagctccatttgccgctacaaagtacttgattcatatctgttatttcatattataatataattatcaaaagttaggggcctcatttccatggcaaccagggtgaaattttgtctttatgacagtcttaaccctacttgattgaattccagaatatccttttgtctcctctcatttttgtgattgaaagcatacaaaatgtctacagttcacctgtctgctgctcccagttttttctgtctaaccataaacgaatctgtgcattcataactaaatcactaactttggcctccagattattttgatagttttagaaataagtgtatataaatatataaataaattattaacaatagagaagcaaatctacaggattgaagtaatatacacaaggtgtgacatcacatacagacagatccaaaacttggacctgatcttcaggatttccagtgcgaggctccttccactaatagatggaagggtggaaagatgccttcttatgccagcgctaacaaaacatgttatgcattgtcattgtcaacatctcactggttgttgtggttatgtggacttttgcagtgtttatattcagaatatggctacgtaagaattagatgaaatataaggaatgactcaaagttggttgtaatatttgaagtcatttcctttattttatttagcatagccacatgttatttggagatagagttttaaatatattgttttacaggttgggtgtccctaatctgaaaatgtgaaattcaaaatgttccaaaatccaaaactttttgagtgccgacgtgatgccacaagtgggtagtgaagatgacgtttttaacactgcagaagaagtgcctataagtgacatggtgaaaatgtgtgatgggattattgaaggaatagagcagcacacattcataacagaacaagaaatcatgtcagtttataaaatcaaaggaaggtttctaagacaaaaaaattcatgaggcagatgactctgaggggaacatttgaaaatcgtatccagcagaattcctcctcatccctataggacccatttccactgcttcttatgttttttcttacctaaaaaaaatgctgtttacagtagccttttaatcaaaacacagcatcataggtggagactgaaagcctgctgctgtttgttgttgctgtggtctaacagctgctataggtatctggtgatgcaactgtgctgcttagctacacttaacacattactttttcactgtattaatgatacgccatattttttttactgttaagtacttatatctgactaaatataagaaaatgattgcttatcagtagcatataaattcagagtcaggaataagctcatgccaagcaaccacagattgtccgtatgggtggctgagatagtgacacctttgctttctaactatttaacgtacacagactttgtctcatgcacaaaattatttaaaatattgtatatggccaggcacagtggctcagcctgtaagctcagcactttgggagccgaggcaggtggatcacctgagatcaagagttcgagaccagcctgatcaacatagtgaaacgctgtctctactaaaaatacaaaattagccgggtgtggtggcacatgcctgtaatcccagctactctggaggcggaggcaggagaatcgcttgaacccggcaggcggaggttgcagtgagccaagattatgccattgcattccagcctgggtgacagagcgagactctgtctcaaaataataataataataataaataaaatattgtgtaaaattaccctcaggctatgtgcataaaatgcatataaagcataaatagattttgggtttagacttatatcccatctccaggatatctcattatgtatatgcagatattccaaaaatcagaaaaaaatcccaaatctgaaacacttttggtcccatgcatttcacctaagggatactcaacccatattggcatataatttttttttgtatatattcttcttcataatatattcaataagataatccataacttttttcgatatgagattagatttttaaaaatacattgtctctagtttcattggtcacttaggaaacaatagactacactgtgtcatttaaatagcactgattagccaaatggccattttaaattccaattcttactctgatttaatagccaatagaagaagtttttctagaggcaagatcttgtcagaaacaattaatgggttgccctttgtggcttctttgttctttttagggtattcttttctatgatttcaaaggttttttttttttttttttttttggtagatgacacagaaacttctcagtttattcccctgtgtcatctaaaatactataatttgccacagaaatttgctctgatgcagtcccctgaaatcattctaccaccctcaattgtggcaggaaatatgtttaaaatgttgtctcagtataatgcaaaagccagagttaagagtgatatggaaaagtgatccgatgaggtggagaggcaagaatagtagcatgaatctcagttgtgtatattttgacaagaaataggaaggggcaaaaccaaggagaaggtggcagggatggagaaaagagggtggctttccaagagataggcttcgtcttggttctgcctgcatagttgcagcacttgagggttggagagggaccacagggggtcacagagctatgtctccagcatcaaaattagagggcccaaagacataattcagaagtttgggatgcaaacttttttgaagttctctcatgagatctgccatcaagatcctgactgttgtcatattgagtttgttttcatagcaagatttattgttatcaagttctatcgtaccttgtaaagctttttttaaaaaaaacttcagagtgattttgagctatagtatggcaaaatttataccctgctacctttctggagccatacaatatactacgacagaaaatataaggtggcacgttgtatataatacaagtgataatggaggaactgaataattggaagtactctaaaactacacccagacacgggggtgggggatagcagtataaaatgttcatcaaccaaagtcaaagtataaaaggagaagcaggactttggagcaggagtgtaagatctcagggactcatgggtggggtgagggtggatatgggagaataactttacaaaatattgagggtaataattacaaagtttggcctacccagaaagactagatagggatgctgaaaaaggtgaaagcgctcacctttttccagccaagactgactatacgtaggtggcttcattctgaaaaaaaaaaataactgatttggacctcctctgggctgtatgtgggcgcagttgagaggatgtactgtcccacctttctgataaaggaactatgtaaataattgctttgttgccaattttaaggaatgacatgtctgtattgtatttctcctcacctccccacccccagcctgctcatttacatttcttttagttctttgaaaaatagaaatcatcactggaatacatgataaccattattaatttcttttgactttcattttctaagaataatgaatacttacctactaccctccatgctactaccgaaaagtggattggaaaataccctttgaaccagagtcttcagtagagtgtctaggtcaggagtgccctgtttgagccattgtgtcctttagaaaatggcagtttatctggcaaattcttgattggggaattgtagatggatcaggcattgtctgattcccttattttcttttacgcatataatttgccatcttataccttttcaaatatattgaattgtccttagtatatgtaatttatttccatagagtctctagcttgttgtactaataaagtgataataataacagtaatgacaataataataataatgtcaacctttttgccaaagaattatttgaatctgaaaaaatgcaataataggtataactgaaagtatgactctatgaagtgatcttaccttatttaagccagtaattgcattgctatttaaagatttttttttgttatggttcctcatggaacagaaaagttctaattgattgtcagcaaatactgtgactaaaattaatatttattacctaactggaaaataatattttataatagtttgatgacattttaaacagattttgaaatctaaacatatttttattgctggcacttctagattcataaaattaagtgacagatgaattcgaatgtgtttgaggacctatgtactatcagatcacaacaaaacttcctaactgccatacaccaaaaaatagacttagggactaaaccttgtcttactgcactgtacagtgtacttttttctgttttctaattgcatatcctctttttctcttggaaaacgttcgataaaagtactttaagaaagaaacttgaagttgagctcctgctattggaaaatgttctgtgtactcttaatgaattgtttgtatatttgtcattaaaacatttaattatattcttacattacagtctttgttttatctaaacttgtgtttccaagggtatatctgagtaagatttaactgaacacaccacactttcagattggatattttactcaaataagacatgattatattacagatggaatacagtcaattataatatttctacatatgttagaagagcaaaggtgaaacagcgaaaactcattaaggatttaataaaaggagccaaaatattaccactagcatttgttaatctaagtgctaaaaatgtctgcctctgaagccagcagaaaacaattatttaagcaagtggaaaatagacaatgaggaaaatggtgctttcaaatatcttcactatgtttgtctatgcaatgacatgataggaagtagaaaagactgttgaagtgtaaagtgtaccaaacttagacaaatactagaaaaaggtctagaatggttaaaaaccaaaggagtttaaggaagctgaatttccttaagaccatgtatctattaatttaccttcttgggaacttcatctgcccaaatttgcactagttttttcttgaggtttaatttaaatctacagtactcactttaaaaaaatccttaatttggttgtaagcaataatatctgtaaataaaagtgtaaaattttagcactgtctaccacttaatcttttatgtgtcccactatggacacactgccttggggaagatgttaaatatatcggagggtaactgtttctataaagatgagaagtaagaaatggaggaagaaatctagagagctaaatacagaattgcataattaccagaggcaggagaaaattgcacaaatctatgctaagtttatccaaatcaggtctctccaattatattgtgagtgggtgatgtgagcctatctggagacttttctgtttcccagtcactgttcccccctaataattatcctgactatatgggatcagaaaaattttggagtgggctttggttggccacctttccctcatctagaggatttgctgctattcttttattctttcactgtataaaaaccccaaagaggagtctctgttaaaatctactgatttttttctatttattctatgtatccctactttaatattcacatattctatgtattatttatatattttttggtctctttcccctcacttgtatatagcttcatgaagacaagaatttgtgtgttttgtttactgccatattttgaactcctagaacagaatctggcacacaccaaatgttcaataaatatttgctgaatgaatgaatgatgaatgattttagctttgaatattatctcatgttcttgttatttcttgtcccctgtcttgataacaaatttcctctcacccagcatttaaaatggattttttcttcttgcattgtttagtctcttccttttatttaggctgcagcttttaaagctacattttatttagttgtagtattaatttatagctgaagctccaaaaatgttttatttttcttttatcatggtaaaattaatcctttaattttattctcccttgtcattgatcatttctagcataagattaaaattatatacttcattaattttcctcacactgcaaaatttagttttacagtatggtatgaaccctgttgttttgagtgttgttatacttcttgtgctttaaacttttgtcatttgatagaaatggtacatttcgaagggtacatgtaaatggtatatttttaattttgttttctttttagcactcaaggagattctgacagaaaatggtatattttatgagtagtgattttgtgaaaagcatttcagagcttccatttcccctcttgctttgataaataccttttacttcagataacatggtagttttggtctgttgttagtaaatatagtcttatggttttcaaaagaaatgttttaacataacttatttttacttcttcactttatatttctttaatgcttaaagtatgttctcaacaaataactgaggcagaacataggtgattaatcaatatgactagagtgtgtttttatcttcgctaagatatgtatgtgaaagatgatatagtatgttttccccaaatatactaatttctcctactttggatattttctaagattttaaactatatttttagattgttaatattttcataaaagctactttaaaaataatgtccatatatgtttgaattgttattacctccaagcctgttcttattctctacacttccttgcaattgaaatcaagtacaatgcttttgatctacaattagaatgtttatcatcaaggggtgagaatctgaactttttcaaacctctggatttgaaattctgtgtgttttctgagtcaaaggatgagtacatctttgaacttcataggccgtaatgcaaggcagacagcaagaaatacaaatactttcccttcttgtttactgtgagatacagacgtgcatttatttgtttcatatgcccctcactttttcagtctaaaccaatgggtgcaattaaattagaataaatgtaaaacaaaaaattaaagtaaaacatcatttagaaaattcagggactgtcaaatgggaaaagcaaatagatttctaaatgcctgataatttaaaacaaaattaatacaaaaattaacaaatagagcattaaaaaaagatagatatgcaaatatattaacatggaggacatttgtttttctgaaagaatatgtaaatctgcaatctttatgaaacgaatttatttaatacatttattagtgaattattattcaggcctgaattttgtggtatattgaggattttactattatcattttgcttttcagttattttccattgtcctaattctctcaaaaatatttggaaactattttttcaatcaaattttcaatattcaaaaatttgacattggttttaagaactgctaagaatatacacttgaatgtatctacatgattagcactgaagtgtcatttttaataatttagtgaaaaaaaagataaagattgtgtcttagtgtgtggtaatataaaattaagatacaaatagggcctagttttccatatatgttaaaatattttattttatttttatcaggtaaaattgagtctttaattatattctctttagtcatttattatttatttctagtaaaataaggagagttaccttttatctaaaagaaattcagctagttttccctacgaaatactaaacatttccacgaaatagttttttaccagtgttgctaagaagttgcagtaaataattttgttctatccatattttagtgattatgctatagctagccctcttttctaaaaatggaattaaaaagaagtgtaaggttaatattgttatgtgtgaatttgatcctgtcattatgatgttagctggttattttgctcgttagttgatgcagtttcttcctagcctcgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgagttgaaaattctttaagaatgttgaatattggcccccactctgttctggcttgtagagtttctgctgagagatccgctgttagtctgatgggcttccctttgtgggtaacccgacctttctctctggctgcccttaacaatattaaccttaaatgtaaatgggctaaatgctccaattaaaagacacagactggcaaattggataaagagtcaagacccatcagggtgcaaagcaaagagttggaaccaagccaaatgtccaacaatgataggctggattaagaaaatgtggcacatatataccatggaatactatgcagccataaaaaaggatgagttcatgtcctttgtagggacatggatgaagctggaaaccatcattctcagcaaactatcgcagggacaaaaaaaccaaacaccgcatgttctcactcataggtgggaattgaacaatgagaacacatggacacaggaaggggaacatcacacaccggggcctgttgtggggtgggggcaggggggagggatagcattaggagatgtacctaatgctaaatgatgagttaatgggtgcaacacaccaacatggcacatgtatacatatgtaactaacctgcacattgtgcacatgtaccctaatacttaaaagtataataaataaataaataaataaataaataaataaataaataaaaaagaaaatgtcattccattgtcttctgtctcattccaggaagtcagctgtaactctcattgtagctctttgaaagtaatatgtctctgaatcacattctccctctctctcttttcacctctttaaaacattttttgtctttgtttttcagcagttttacttttatgaagggcctagatgttgtttttttcttttctttttgcagtatttcatagtgcctattaaatctgtggcttcatattttcaattttgaagagttctctgcctttatttgtttagattagttttttcccattttgtctgtcccccaagccctttctttaaatttagttgctcacatctaggacttttttcctaagggtctcttagatttattctctgtattttctttttgcctttttatgcctaaatctgtccgtattctagttttgctattcagtttttagctgcatctaatcagctgcttatcccgtacttgggttcttattttcacttatactttttctagaatttttatttgtttttctttttgtggtgtctatttatcttctgatataaccaacttttaaagaaattcctcacgcatattgatcataattatttcaaagttcatgactgataactctattatatgaattcttgtgagttattttattgtagtatttttctcttagtttttgactatgtcttattttcatgaatacatgattattgatttatattagacatttttttgttttaaaatttagcaaaatgttgaggctctgaaacatgttatattcccttagagaagatttacttttgtttctggcaagtaattggcctgggaatggcagtattccatgattaccttaatgccatcaaaacttgagattattggaagcttgccttcatttcttgagatgctagcctatttaagaccttgcactcttcctaaggtctcctaatggaaagtttcttgtgtctagtctttcctatttgttaggccataaactttcatttttatcccgtttaagccccagaatcttttggaagatctgttcaattttctaacttctcagctcccactgcagattctagatatttggcttagctatctgggatttactctactaccttcatcctttcacatttctttctgctttggtatttctctgatggcttctaataattgtttttatattttcccatgatcttctaattgttttcattattatgttttgtgttacacattctagttcaccactggcagaagtagaagcaaagatctggtttggttctatgcttcttagtcccagcctctcatgcataccaaagacattacaagggagacaatatttgtcaccaaaaacaaaataaaacaaaaaacaaatacaaaaaaattcaccatagcactagtggtctttaccctgcaccaataaggtacattcagatgcaagagagacttgttaatgtaaacctcccatgacgatgatgattggtacatgagtggtcaaaatttaaatcagagcttctcttctcttggctaggcaccaaggtctagaggaataataatattagatatcatcttcctgaggaaaaaaccattaattctttatatagatgtcagaattttaagatgcagattactttaaatttgttttacctatttttactccttttagttttttaccttcattttaaacctaaaagtggataatttttaaggtttatatatagttaccaggtttttttaaagtacagtaaaagaaaaagtatagtatagctttatgttgtatgaaaactctaaaagggaattttttcactatagatgaaatcttttaaacataatacttattttctgttaagattacttaaaaatctgaggtaccccacatggtggcctcataacccaattaagattacttaaaaatataaagagagacaaaatgtatgcataacttttaaaatttatttttatatgaaggagttctgtaatttagtgatgatttataaatcaacttgcctgtcctttatttatttatttaaatagtttttggggaacagatggtttttagtcacatggataagttctttagtggtaattaccgagcttttggtgcacgcatcatctgcgcagcatacactgtagccagtgtgtagtcttgtattccttgcccccttcttcactttccccagcatccccaaagtctgttttgtcattcttatgcctttgcatcctcatagcttggctcccatttaaaattgagaacatataagatttggttttccatttttgagttgctgcacttagaataatggtctccaattccacccaggttgctgtgaatgccattattttgttcctttttatggctgagtagtattctatgatgtatatatgccacattttctttatccactcattggttgttgggcatttgggttggttccatatttttacaattgtgaattgtgctgctataaacatgcatgtgcaagtgtcttttttcatataatgacttcttttcctctgggtagatgcccagtagtgggattgctgggtcaaatggtagtcctacttttagttctttaaagaatctccatactggttgtactagtttacattcccaccagtagtgtaaaagtgttcccttttcaccacatccttgccaacatctattatttttttattatggccattcttgcaggagtaagttggtatctcattgtggttttaatttgcatttctctgataattagtgatgctgagcatattttcatatgttttttggctatttgtatatcttcttttgagaattgtctattcatatcatttgcccactttttgatgggattttttttcttgccaatttatttgagctccctgtagattctggatattagtcctttgtcagatgcatagcttgcgaatattttctcccattgtgtgggttgtctgtttactctgctaattgtttcttttgctgtgcagaagctttttagtttaattaggtcccatcgattcatttttgtttttgttgcatttgcttttgggttctttgtcatgaactctccctaagccaacgtctagaagagttttacctatgttatcttctagattctttagtgtttcagatcttagatttaagtctttgatccatcttgagttgatttttgtataaggtaagagatgaggatccagtttcattcttctaatttttaaaattagttaatttattaatttgttttttcccagacagagtcttgctctgttacccaggctggagtgcagtagcatgatctcagctcactgcaacctctgcctcccgggttcaagcaattcccctgcctcagccttctgagtagctgggattacagccatgtaccaccatgcccagctaatttttgtatttttagtagagacggtgtttcaccatgttggccaggctgatcttgaactcctgaccgtgtgatccacccgccttggcctcccaaagtgctgggattacaggcaaaagatttctttaatgtcacctcccttaacttgagcagttagaatggtttgaaaaaaatgagaaatattttgaaccttgtaaatttacaaattcatatataaacttagggtgctaaaacaaatagttctttccttttaaattttataatttgattttaatactctttctgtgtcaattatgtatattagcccaagttctatcctttgggagctattttgctttgtttctgtagctcatacttaccctcagcttttcattctgtgaaagtatgctatttactgcaagggattgtgaatttagtttcaatgtaactggtaaaaacaaaaaaacagaaagatgagctgtttatgtaccattagtcaaatatttattaagcagctgctatgttttaagcactgtgctaggtgctggggacccaaaaatgaatgaaacagccttttcttcagggagctgctggcctaatggggatgcagacaagaagaaagagagttatttatggtgtgataagtgcaactgtagaattaatggagtatactatggaatcacattcttttctaacagttgctgaacagtgtcttggtatgtagagaagtagtagcctctgctgtctatcctttgtttatgggatatagaggggaggcggggaaaactcatgaatcaatcagttgttacagaacagcattccaatgagttgtgtaaaagaattggaaacagattgaagttccttaattcatgaatctctaaaagtggttggggacaagtgtgctttgctcttgccaaagtgtagtgcatgaaagatagtgtgtcattttactgacccatatccaccctcaaattaagttactcattgtgctctcatcagattttaaaagagaaatgcaaaacatggatattagtagaaatgccacaaaatacaataatcagataaaacagtcttaagaagaacactgttttgtgtgtgtgtttgtgtgtagaagtatgagtacatatgtgtttgtatttttgcatggacatacatttatttgtgtatagtgagtatttatatgaaggtacataacaaaatgaactatggttaaacatatttatgccactagtgggtagtgttagtggagactgtcagaattaacttcataggatttctcagtgcaaaaaaatgtcatgataatgtcatgtctgcctttctcaaagataaaggtactttgattaaccctaagctccctttttttgttttaagagacaggatctggttttatcacccaggctggagtgcagtggtgcaatcatagctcatttcagttacggactcctggcctcaagggatcctcccaccttggcctcacaaaatgctgggattacaggcatgagccaccacacccagcccctaagctccttttaaagaggcaatgtgatgtagtggcttaggacacagtctggacagactgcctgagtttaaatcatatatctatcatttgttatatttgacacattccttaactttttagtgtcctggtttatttgtctataaaacattttaataatccctatcttatatgctcttgtgagcattaaatgatatatgtaaagttcttaggtgaataatgggtatgcagtaaggaatacataagtataacaaacactgatggttacactttatgtggaaggcctattccatactgagaattggttatggcagacagatttgtggtattctttctttgctctccatttccttcaatggcttaagagtacttgggacaggatttagggagatctacagagtaccatcataataagatgtaaattacatgcaaatcagtaggtacatattatttgtccagcatgtacttgatgttaaaagaaaatttggatacatagtgaaaacaagtataattcctcagagattgtttggagtccttccaagtgtttttagtgatcagaaaatactgaggtgtttagctgatgagaaaataaagagaaaaaaaggggaagctattgtcaagtaaaatagagacagtcactttggaacatcagtaagtgaagtttttttatttcattgtagaaatgaggaagcatgttgaaaaattaatttgggttagtaacaaaatcccttttgttgtgatgtttgtattcttaaccaaaaatctatcttttttctactttcgcatttaatgtgacttttttcctatacttattttgaactcactgaaaatatactttatatcatctcttttgttttaacagttatagttcagagtaggtgaaaaataagaataatatattagtttcattatcactacatctgttatctacacatgtgtgtgtatgtgtgcgggtgtgtgtaatctgaaaaaacatagaattgaaaatcaagaaacctatattccagccatagtttatctcacctataagatgtgtgtatgttgaatgagaacgttatatatgcaaatgatttattcgttccttcccctgttcatttatttaatttattgaatgtcttttatgtgtcagatactgacagtacaaaggtgagtaactcatagactctgtctacaatatactttacatatagtagaagactaattcacagtagagcatgtgacccaagccatgtaatcaaagtcttcttgggaatttttgtgggagtcttggagaaacgtgattttttttttccttttgattttgtgctagaaggacatgataaggataaagatgctagtgaccatctcttagaccatagtgttttggaaaatgaggtcaagataaaagaaagcaaagctaaaagctggagaggagacaatatgtttctttggtgatagagatgcaagaaagggaaggctttaccaggtagaggaggcaccacaaacaaggacatggagagatataaaacaatataatgttctaaatgaaatgtaagatgtgcagaggggttgaaggaatggagggaaagttaggcagaggctaagtataaaagatcttttaatcttgcaggtagtggggagccattgaagtactttaaaaataatctggcaataaagtaaggagagagaatctacatgatgtggtaaatgacctaattgggaaggtgagagaataggtggaatgtaggttggcttcaaggtttcttctgatttgggtgtctgattgcattgtgttattattcaaaaagataagaaattcaaaaggagaataaggagaaaagataattactgttcttttggaaataatgaatttgaagttcatttggaagatctacctggaagtgtcttgactaaagttcggcagagggctctcttagttgaccatccgattacagctatcaacacagatgtgatagtggaaaccatgaaagtgaatgtaattacttggaaagagcaagtagttctagaagagaagaaagatggaggcagaactttgggtaggtgaaagaacatgaaaggagactaaaagggagaggtaggagagggagtggtgtcatggaggctagggaaagaaaaggtttaataagaaggcctgctcaataatcaactgcacagagaagtcaaacagcattactgaaaacaatctattggattttgcaattaagaggatatttatattcatccaagagcaatcttttttgagaatagagtgaggaggtaggccaaggtatgattgtagtggattgaagagtaaagagaaaataaaagaaaagagtgatagtagttctagaataacgtaggattgaggaagtttggtttagtttggattgtaagatggaaaaccacttaaatagattttgaagaagaggtcagtagagaggcacagattgaaaataaaggagatggagaaagtgaattatcagtgaatttctggagaatatatcaaggaaccatgtggagggtgacttttcgttaggaatgcacctttttttgatactagaggaaggaagggagaggatacatatggacatggataggcatatcagtcaagttataactatccccaaaagaagccacttaaagtgtttaaaagagaaggaatttaatgcaaataatttgttaataggtcatggaagaattggaaagctaaatagggaattgtaaaccaacccaataattaacaagagcatgaagccaataagctggagggacaaaaaaggaggtagcattactaggagtggaagctagaaccatgccatcctgtctgttaccctttgaaggaaacaagctctggtagagataccatcagaggcagagggtaggggagaggaatgtcctagcttctctccactttctccctttcagtctcctgctggtgccccccagacatccagcatgaagcctccagggtcaagctttgtgccatcttaagcagagccaggaaaaagaacaaaaggctctgagctcaaacaggcccatgactattataatagggttggaagtgtgtgagagaggaaagaaaataagaaacgaagaaaagccaggcatggtggctcatgcttgtaatcgcagcactttgggaggccaaggtgagtggatcagttgagcccaggaggttgagaccagtctgggaaacatggtgaaatcccgactccacacacacacacacacaacaaaaagttagctgggcgtggtggcctgctaacttttactcccagttacttgggaagctgcagcaggaggatcacctgagcccaggaggtcacggctgcagtaagccatgattgtaccacttcactccagcctgggtgacagagcaagaccctatctaaacacacacacacacacacacacacacacacacacacacacacacacacacacacaacacaagtgaaggaaaaagatggtaggagtatgtgcatgaaaattggtaaagctactatgaagaatggttgaaggaaccgagcaggcatatataatacacaatgcaatttggctgatgatccatttcatttctagacaagaagttgctatagcaccaatttgcactactggacgtaccaggaatacatgtccacaggaccagagaagcttctctgagatccaagtaaatatattgtaagtaaacaagtgagaaagcttacaggagaaagagcaactgtgagagactagtatgttgtcatttaagattttggaaggggaacagttctaagtactaggaagttccatgaaaacataagcaggggtgatttctgtgttgcagagagggtaaaataacttgcatactaggtaattgagagctattgacatgggtgttgaagtcagcagtgattataacattttttagggtaaaaaggaagaccaagtcaggtgtccaaatcttcagggaattaagtgatcatctggaaaagacaaggatgataacagtaaagagtagaaagtgatacacttgatatgtgtctctaagagcagagggttttgagataaggttgggaaagtaatggtataaatatggtgattaagagagtgctacccatggccctgtgtcacgtgaggagagaatgaggaatttccttatgagaaggccaggatctagttgaaggaagaaggcttagaagtgttctggaattaggtctaaaatggcaggtaattacaacaaaatgagaatttgagagcaaaatgggtagaggccagtagagctgtaggaagaaaatggcagcttggggaataacactgtttagacaattgatagatgagactgaattttgttgaggggcaaataataaccagaatgcaaaagactggttggatcagctggcttcaaaattcctggtctaggaaggctgaagtccttgtaggttttggagggcccctgtgtttagtagcctttgctcagtgctgatgtttcatgtgctgcttctgttcctccctctgctgttcattcaaatatattacacttggaaagtagttcttgtctcttcattccagcataaccttagggtccagtttttagaagtttgaatgtttacactgggttatcattattcactacagatgcatttccaagtatcacagtgaacagatgatcagctgattctttctacattagcatagaaaagagtccccaggtgtgagaatgggtcctggtaagggttgtatgatggactttcttattttcacagaggaggtattcagtaaaatgtttctgaagatgatcttgatcagaggatggggaggaggaagagaaagaaaataaagggggtaataaattaatgaagtggctaatgaccatcatgtggctgactcaatatacactcttatccatgtaccaaatttcactgaatctaagggacttttttttcacattttttacaataaatttttacaatagtttttttcacattttaatatttgtgaaatgttaatgacattacaattagaattggttatatcttttcttttgtgtcagtccatacaacactctcatggatttagcaaaatctgatgtgtgtttattttcattcttatttgcccctactatatctcacattttaaaaacgcttgttttctttgtgcttattttccttaagttctttaactctactcaaattcaacctgttccccgccttgtccttttttttttttttttttgagacagagtctcgctctgctacccaggctggagtgcagtggcgtgatctgggctcactgcaagctccgccttccgggttcacgccattctcctgcctcagcctcccaagtagctgggactacaggcgcatgccaccacgcctggctaattttttgtatttttagtagagacggggtttcaccgtgttagccaggatggtctcaatctcctgacctcgtgatctgcctgccttggcctcccaaagtgctgggattataggcgtgagccatcactcctggcctcccttgtactttttattgcaacttcatttttcttttggcttgtagttttcagaatattgttttttctccaaatcctcagctttaagaagatagaatataatacacattctctaggcctaactcttttgttaagtatcacatggctcttgggcaagcaattcaacctctttgggccataattttcttatatataaaatgaggggttaagtctaatgataccaatagtctctttctgttttgaaaatttggggtttcttgatcatcagagggctgaaaaatccctactctaagcctttgagaggaatcagggcagaggataaggatatagagaactctgcctcttttcttagactcattccttaaacctgcatattctacatattctctgatctacatattctctgacttttgttgctgccaagctactctggctcaaggtttttatgtctgggcatagacatctagcaacatcatcttcatttatatagatctactagataaaaaaatagcatatgtccctctcttcaagtttagtaaaaagagtcaatattttttataatacataatttggatttttaattttttcctgggaagttattgttttctgttgtctctagcacaaattgaagattaagtctcagaatggaaagtttagaagagactatttgctgtggattactgttatatgtatatgtatttgtatttgtatgtataaagtataccataaaataaggtagcttgctagaagtcagatcattagttatcaggtcacccagaaagtggggattgttttattgcctgttggaattgaaatggtgtttctgtagaacatattgtaatcagtattttttagcatggataaatactggaaaataaactcagttggaagtgaaaatagttgaactccaagttctttttatttgccaagtgatgactttgggctagctaaaatatctattaatttttaagggaaaattaatggtagtgtcaggtcttaattacagagtagatactacattagattatcactagaaaggacaaatgatccaagagaagttatgttagtggccctatatgtaaggaaactagctcggaaggaagctaatagttccttacgatttcctagggaaattgctttaaataatctgtagtttggtagatattcatatcccaaaagtcacttaatgacagcacaggttaagactacaacagtgctgcaaggaagtgtatatagttcatttaggggaataatttaatatgagggctagaatataaaacaaaatgtagagttaacaattgtctagcaaattcaagaatgttggtagggaagcactgacttaaccaatgacgtatacaattattagagagttactttggtcagttaaagcaaatgcaaaaataacaacaaaaactaatctttctcaagtatctattaacattctagatattctctattttaaatttcaagaagggcttagagatagggtgaacatgtaatttatcattcaaaccagggcaataagcataaactaagcttattcctggaaatcaagggtataaagttgctctagttaggtcttaccatgtgtctactctcatttctgattattgctaaaaatgttaagaaatgaactagttaacatgccaactgaagagaaagagacaaaaatctttctcagtaagcctctaatctgttgattctaaccttttggggagaactgatgtcttggaaagtgatgacatggactctctccaatagaagtgaattgaaaatgaaatatgagggattcatagacccctgaaaaccattcatgggcaagaatcttagcttaaagccagaaaaaagaaataggatatcaattttttattatggtaaaagagctacccacaagcaccaccactactcaaacacattttgatgaactgtaacataattaacatttcttattataaataattcaaatatatacaaaaatagaaagaatattataatgaaaccccatataactatcatgtgaactcaagattgcataagatttgtccatacttgtttcacctattcccttttttagttgtggttgtttctgaagcatttttaaacaaatcccagattcatataatttctcccctctatactttagcttagcagaatgtcattatcacaactaacaaaactgacactgattcttcagtatcatctgatactctattcatattcaaattttatcagttgtgtcaaaaatgttattttccattggatttacttgaattggtatccaaacaaatatcacgctttgccttttaatttttatagtccctctactgccataacctttctccctttttgaagcaaactggtgcagttgtgtcatattatggatttgattcttaatcccctatatttcttgtaaacaagaagtgagttgttaggcttgcttagattcagattagatttattttcctttttccaggaaaatttccatagatgatggtatatatttcataggttatgctctataaactgatattttaggaattgctgaatcagaaattagaatcttacgaccaaaagaaacaccaggactaattcttttttctcactttccaaaagtatctgtggtccatccaatgttctttcagccatcaaaatattaactattcatatgaaatatttataaaaagtgacgtcaactatatttccctttaatattcattttaaattattacagtgagcatgtacttttcattcttgtcccttctcttttctggtttcctttatcccattcttttaaaaacaagctatcagttcccatagcagcctttaccaaggtagataaatatcaacatcatggttgaaataccaaagctcagtgccagcaattatcctacaatttgtgtgttggcgtaataacacacagggacttgagcacattactaatagccattgaggggagcaagctagtctctaaacatattaaaatgcctcagaggactttttcagcactacataatcaagatttggtgatacgagctgctttgttaggacttgtgaattttgcattgccttattgtgtgtgtggaaattagtgccgaccttcataaattggcttagataatacacagatcaaccaacaggagacagaactagccaaataaagcatatggcaaatcactggaaaaagagcgtattatgtagtgacttttaatttggaaatgagaatgtaagaatatctccaatttaattggggcttgtctgaaaaatgcgttgatatctgtcatttcagaattgaaatgttttgatttgctgaagttttatttgctttgctgaggacaaggatactaccaggaatggggtctgacaaaaataaattattaagttgggttattcttatttttattctttttcaagatagtattggcaaaatctatcttgttattcttagcaacataaataagaagtattttgggggtaaagagcatattagaaagaagtttaaaaattttctgtcttttgttatatttgattttcaggaaaataaggtgaaaaaacatctattttcatacaatttctttggatttaattatacaaatagtcattaataaagtaagaataatgcatggtttactggataaaatttgaaggatttctgttaacactgaagccattctttaaacatgctggaatttggaagtcagattttcttcagcgtctttgataaacttgtgggttttttttttatcatgttgatttttaaagagtgtttttggatttgtatctccctttatttatagtttattgtgttaaaaccctcctaattgccactcctcatcctaaccctgggaaaaattcttgttattggttactcccattccttagggatattatataagcttttttacctactactccaagaaatctgcattatatgggcattattatgtattatattcaataaagaaattatagggcaaggcagctgccacatgaaaaatgacttgtttggtattgtctgtttttttagagaggggcatggaataaaattaaaaatatataaggctcataaagctttaatggtgtgtatatatattaatttctctcaaaaacaacatatgaaagtgtctatatgcacacaaacatatatacacacacatatatgtctacatacgtgtgtgtgtgtataaaaggagtgattccattgcaaggtggatctaattattagactatgtcctctcaaccgggcacagtggcttatgcctataatcccagcattttgggaggctgaggtgggcggatcacgaggtcaggacattgagatgaacctggccaatatgttgaaaccctgtctctactaaaacacaaaaattagctggttgtggtggtgcatgcctgtagtccgagctccctgggaggctgaagcaggagaattgcttgaacccgggaggctcaggttgcagtgagccaagatcgtgccacagcactccagcctggcaacagagtgagactccatctcaaaaaaaaaaaaaaaaggttttcaagacaagtaccatgtctctcaacctcttttttcaagaccaaatgtcttgcattttctcaactcaactttttttcctatgtcatcctttcaagacacttcaggtgagagagccaagatggccgaataggaacagctctggtctacagctcccagcgtgagtgacgcagaagacgggtgatttctgcatttctatctgaggcttaaaaaatggcgcaccaggagattatatcacacacctggctcagagggtcctacgcccacagaatctcactgattgctagcacagcagtctgagatcaaactgcaaggccgcagcgaggctgggggaggagcgcccgccattgcccaggcttgcttaggtaaacaaagcagccaggaagttctaactgggtggagcccaccacagctcaaggaggcctgcctgcctctgtaggctccacctctggggacagggcacagacaaacaaaaagacagcagtaacctctgcagacttacatgtccctgtctgacaggtttgaagagagcagtgattctcccagcacacagctggagatctgagaacgggcagactgcctcctcaagtgggtccctgacccctgacccccgagcagcctaactgggaggcaccccccagtaggggcagactgacacctcacacggccaggtactcctctgagacaaaacttccagaggaacgatcagacagcagcatttgcaattcatgaaaatctgctgttctgcagccaccgctgctgatacccagacaaacagggtctggagtggacctctagcaaactccaatagacctgcagctgagggtcctgtctgttagaagaaaaactaacaaacagaaaggacatccacaccaaaaacccatctgcacatcaccatcgtcaaagagcaaaagtggataaaaccacaaagatggggaaaaaacagagcagaaaaactggaaactctaaaaaacagagcgcctttcctcctccaaaggaatgcagttcctcaccagcaacggaacaaagctgaatggagaatgactttgacgagttgagagaagaaggcttcagatgatcaaactactccgagctacaggaggaaattcaaaccaaaggcaaagaagttaaaaactttgaaaaaaatttagacaaatgtataactagaataaccaatacagagaagtgcttaaaggagctgatggagctgaaaaccaaggctcgagaactacgtgaagaacacagaagcctcaggagctgatgcaatcaactggaagaaagggtatcagtgatggaagatgaaatgaatgaaaagaagtgagaagggaagtttagagaaaaaagaataaaaagaaacgaacaaagcctccaagaaatatgggactatgtgaaaagaccaaatctacatctgattggtgtacctgaaagtgatggggagaatggaaccaagttggaaaacactctgcagggtattatccgagagaacttccccaatctagtaaggcaggccaacattcagattcaggaaatacagagaatgccacaaagatactcctcgagaagagcaactccaagaaacataattgtgagattcaccaaagttgaaatgaaggaaaaaatgttaaaggcagccagagagaaaggtcgggttacccacaaagggaagcccatcagactaacagctgatctctcggcagaaactctacaagccagaagacagtggagggcaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaaacatgccaaattgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgtgttgtattcaggaaacccatctcacatgcagagacacacataagctcaaaataaaaggatggaggaagatctaccaagcaaatgtaaaacaaaaaaggcaggggttgcaatcctagtctctgataaaacagactttaaaccaacaaagatcaaaagagacaaggaaggccattacataatggtaaagggatcaattcaacaagaagagctaactatcctaaatatatatgcacccaatacaggagcacccagattcataaagcaagtcctgagtgacctacaaagagacttagactcctacacaataataatgggagactttaacaccccactgtcaacattagacagatcaatgagacagaaagttaacaagaatacccaggaattgaactcagctctgcaccaagcggatctaatagacatctacagaactctccaccccaaatcaacagaatgtacatttttttcagcaccacaccacatgtattccaaaattgaccacatagttggatgtaaagctctcctcagcaaatttaaaagaacagaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaattcaggagctggttttttgaaaggatcaacacaattgatagaccgctagcaagactcataaagaagaaaagagagaagaatcaaatagatgcaataaaaaatgataaaggggatatcaccaccgatcccacagaaacacaaactaccatcagagaatactacaaacacctctacgcaaataaactagaaaatctagaagaaatggataaattcctcgacacatacaccctcccaagactaaaccaggaagaagttgaatctctgaatagaccaataacaggctctggaattgtggcaataatcaatagcttaccaaccaaaaagagtccaggaccagatggattcacagccgaattctaccagaggtacaaagaggaactggtaccattccttctgaaactattccaatcaatagaagaagagggaatcctccctaactcattttatgaggccagcatcatcctgataccaaagctgggcagagacatagccaaaaaagagaattttagaccaatatccttgatgaacattgatgcaaaaatcctcaataaaatactggcacaccgaatccagcagcacatcaaaaagcttatccaccatgatcaagtgggcttcatccctgggatgcaaggctggttcgatatacgcaaatcaataaatgtaatccagcatataaacagaacgaaagacaaaaaccacatgattatctcaatagatgcagaaaaggcctttgacaaaattcaacaacccttcatgctaaaaactctcaataaattaggtattgatgggatgtatctcaaaataataagagctactctatgacaaacccacagccaatatcatactgaatgggcaaaaactggaagcattccctttgaaaactggcacaagacagggatgccctctctcaccactcctattcaacatagtgttggaagttctggtcagggcaatcaggcaggagaaggaaataaagtgtattcaattaggaaaagaggaagtcaaattgtccctgtttgcagatgacatgattgtatatgtagaaaaccccattgtctcagcccaaaatctccttaagctgataagcaatttcagcaaagtctcaggatacaaaatcaatgtacaaaaatcacaagcattcttatacaccaataacagacaaacagagagccaaatcatgagtgaactcccattcacaattgcttcaaagagtataaaatacctaggaatccaacttacaagggatgtgaaggacctcttcaaggataactacaaaccagcgctcaatgaaataaaagaggatacaaacaaatggaagaacattccatgctcatggataggaagaatcaatatcgtgaaaggtaatttatagattcaatgccatccccatcaagctaccaatgactttctttacagaattggaaaaaactactttaaacttcatatggaaccaaaaaagagcccgcatcgccaagtcaatcctaagccaaacgaacaaagctggaggcatcatgctacctgacttcaaactatactacaaggctacagtaacccaaacggcatggtactggtacccaaacagagatatagaccaatggaacagaacagagccctcagaaataacgtcgcatatctgcaagtatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacagacagcctacagaatgggagaaaattttcacaacctactcatctgacaaagggctaatatccagaatctacaatgaactcaaacaaatttacaagaaaaaaacaaccccatcaacaagtgggcgaaggacatgaacagacacttctcaaaagaagacatttatgcagccaaaaaacacatgaaaaaatgctcaccatcactggccatcagaaaaatgcaaatcaaaaccacagtgagataccatctcacatcagttagaatggcaatcattaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactgtaaatcatgctgctataaagacacatgcacgcgtatgtttattgcagcactatttgcaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagtcaatgggtgcagcacaccagcatggcacatgtttacatatgtaactaacctgcacattgtgcacatgtaccctaaaacttaaagtataataataataaaataaaataaaataagacacttcattatgctattgtaattccttttaattactgcattttgacactattgtattaatgtagtactgagaccctaacatactaccaggtatggtctcattagaacattaagactattattttctgatatctgacatctgacatgttgtgctgttggtttttccattagtgcaggctaatggatgagataatttttagttgcaaaaccatagaatacttaacagtcacctaatctttatgtcttcttcttcatcatttctttctaacagaaaatactgtcggaccatgtcttcctcatcttatatgtgtttaattgagtctccaagacacattaattctagttcccaggtttacatacacgtgtcagaagagttacaattggctgggcttggtagctcacgcctgtagtgccagcactgtggaagtccctggctagctgatgatttgagatcagcatgactgacatggtgaaactgtgtctctactaaaaatacaaaaaaaaaattaactgggcatggtggcactgtggctcacgcctgtaatcccagcactttgggaggctgaggggggcggatcgtgagttcaggagagtaagaccatcctggccaacatggtgaaaccccgtctctactaaaaatacaaaaataagctaggcatggtggcacgcacctgtagtcccagctactcgggaggctgaggcagttgagaatcgcttgaacccaggaggcggaggttgcagtgatcacgccactgcactccagcgtggtgacagagtgagactccgtctcaaagcaaacaaacaaaaagatacacaaactcagaaaatggtttccaaaaagctagtttacttgatggtttaaaggtatggggagagtaactagtatttgaatagcttaaataaaaaatgttttgattaactaatgaaacatggtgggctgaagatcttatatcaaagaaaagggtggtggagaccattgttttatttattcattcatttattaagtatttatttgtcaccactttagtgccaggcattgtactcttaaaaaaaaagagagagtgagagagagagagagaaaagaaataggtagagaatctaatttaatccgaggtgtgggaggaggaggagaggattaaaatggaagaaggtaatgtcagcctcctgcaaattcttttctcactctgtaattcttccatatggaggaaaggaaagcagagtgctgaaaggatgaagtaaaatctgcagaattatttcaccattcagcattagatttattaaaaaagcatacaactgaaagttttctaggttgaattactaacttgccttcttagaagaatctggatacttagtttgcctgagggaacaaatatttggaaagggcttccaacttcaggctaagacaagtgagaggagttataagatcattcaatcagaattagtgtataagcaaatgtttagaaaatgctgagaatagttgatgaacagtgaatctttattagctgcttgtttacttttaaatctcagagtaattttaaatattaacattgcttaatgttcagcaatttccaaaaagttaataatttcattgaagtattgtttctttcaaaggtattcagatacatacatgggcatagtcatgcacgcacacactgacaacacagtctttgttcactttgttgccagttggcttttttatatggaatgtagctgggcagtggtgagaggcaggttatccactagtggacaagtgaccataatttaattttgaaaggactgaaaattaattgctgtgagtagcctataaataaaacgacactacttgagtacttgtttgagaataataataatatttgctctaagttttagccatctctttttcagcaatattttttcttcttccttaaactaattggttgtgcgaaaacatgtggttggtaccactgtaaagaaatatgtttgcataatataaatttaatctgaaattaactcttaagaaaatgaaatggaatttacttcacattaattgtgtttaggttagccaataattgtattagagaacattagtacttcaaaatactatcattttgaatgaattgctgtcatatttaacaacattttggagtacatgagttctgcctcatgagtacatcagaaaaaataatcagtaagttttaagtaagacttatttaaatttaaatactaatttaaatgagttacttaagtaagagttacatattgttttaaatacagtgaaatgtaagcaagaatctattcttaaatgaagtcattgttactataatacagagtttttgtcatataaagtttgtgaggagctgggggtaatgtagggtagaacgtggagcaagagtctgtgttggatattggaggccattagaggcctttgcatacttccaggcagggcaggggagaatatcaaaatgatgtttgaagaaaaaattctaattgatgtgttgtacatggggtactaaaggcttatcactgagtaagaaataacatttttggagttagagcaaatataatttccccttctagtttcttacgacagagaaggaaaataatttccttttcacagactatcttctctcctcttcctaaaaacaaaaacaaacaaacaaaaacaagtgtgatattttattgaccagcttacatctaggacaatcataccttttcttccattaccattatgcttgatttagttgggtaatagtcattcttctactctgtgaattgcagtaaatttcttggtagatttatgttaccttaagttgatttttttttcttgtgataatagtcataacaactttaataaaacatagcaatatacagattccctgtattttatcagataatttacttgcttttgcataattagtctgcaaagatttgcttctatttttgcagatggagaatttaagtctcagagaggcttgtaacttccttgtggtccctcagttgataagagacaggggcaggatttgaatgacaaagtatttgactcttcatgatactctaatactgtttaattgtaacctatcttttcttttacaagacacatgtatgtaatacacaaaatttacatccaagagatgtgaaagcatagatttttttctttctgaatccacattttaaatgaatggtgtggtacatgaggttctttcctacacttgggaaatgtatggcactaacgcggaaacatttctaagttagtttgtcacatggggattcaatcaggaataactgtgtgacctttaagaaaattaagattggctgtcagagggaaatttctatcctaccctatgggatagtcttacagagaaagagggtatcactttcaattctcaataaagaatggtaacttattaacctagaacatgtgtttattactgaatatagtcattttaataatgggagaatattctatgatatctttcctatttttaatgtctatttagaactttaatttatcacatacagaaaaacatgatctaaagccttcaaggatctggttcactacatgaatgagtttttaaaatttggagaaattcagaaatcaagaagtacatatataatgataggccaaaggatatcataatttagccacattcgtagttacttaaagacaccaaagaaatactgtaggagtttatgattttaatatcttttggaagatatatgcttaatgtgctttttaataggaaattttgaagcttttcctaaggttgaatataaaatattggttcaagaattatgattgtgcaatgcctaataaaaagaacattctgtgaaaaatgagtagatggtagaggaatgccacctagaagaactttgttagaaactagattagcaggtatctgactaggaccaaggatctcttccccaagtataaaggggccaagaaaattatctcaaagttctgaagattgacacaggcacatttagcccatttaggtcatgagtttgtaaagcttgtgtgtttgatgaagttcaacatttttagaaagctctagcagtttataaaagcaataaaacatttcacctttttaagcatctttgtaggaaaaaaaacttccatatactatcatgacaccgaccctctttgggatgacgttattgcattagtcgatcattatttctccttaaatataacccaggagataaagctgtgaagatagcatgttttataaaagctaaaagttattgtgaattcttctgaatcaataattgaaaagaaactgaagggaaaatttttatatagcagcagtttccaagttattacttttaggaaacttttatactttaaaaagttattgaggcccccaaacagctttactttatatgcattttataattaacattttttagtttagaaatgtttaaaatattaattcactaaaatactactagtctttacccaagaaaatcacaaagataattcacacaaaatttgtacacaaatgttcataatttttcataatagccaaaaaatggaaacaaaccaaaggcccatcagctgatcaatggataaatcaaatgcaatatatccatacaatggaattatttgcccataaaaatgaatgaagtactgatatttattacagtatggataaaccttgaaaacatcatgctaaaagaatacagacacaaaaggtaacatattgtatcattccatttacatgaaatgtccagaataggcaaatccatagaaacagaagtagattagttggtgccagggagtggggatagtggagaatggggattaactgtgtatgggtatagcgtttctttttgggatgttcaaaatatctagaattagatagtggtaatacttttgcaactttgtgaatatatttaaaactgctgaattgtatattttttactttatttttttaaaggtcatcttggcttcagatgaattctgtactttacaatggtgaattttatggtatgtgagttatatctcaattaaaaatataataagcagccaggcgcagtggcttatgcctgtaatcccagcactttgggaggacaaggcgggcggatcacaaggtcaggagttagagaccagcctgaccaaaatggtgaaaccctgtctctcctaaaaatacaaaaattagccgggcgcggtgatgtgtgcttgtaatcccagctactcaggaggctgaggcaggagaattgcttgaacccaggaggcggaggttgcagtgagctgagatcccaccacagcactccagccttggcgacagagcagactccctctcaaaaaaaaaaaaaaaaaagaaaagaaaaatataataagcacattatattttatcctaaattatatatttttatgaaaaacaaatgtgtattccaaagaaaaatattaatgagtagcattgctttacattttctacatacctttttgctgtttggcttcatgagaataattggattctatgtttgcttctacattcaatttattgtaatatattgttttggttgaattatataagaaattctcgccataggcacatatatagttagaaaagagaggagtatcgtaataaattattcagataattatagatatttttctttgatattgtgacaaaatttgttgtgtgatgattcttaaaggttagttgaatgtagaatttcaaatctccaaatagtgctgacttgactgcagttattcaaaggttagactgggctaggaagttgaagatgactgactcacgtggctggcagttggagttgactgtctgctggatggtcagtgttttccttggttatgacctctccatgtgacctgggcttcttacagcctgatgggtggattccaaaatgaaatgttccgtgagaaagtgagaaagttgaagctaagccatcaatgttttaaaggcttgtattcggccattcttggattgctttaaataccggagactgggtaatttaaaaataaaagaggtttaattggctcatggttctgtaggctttgtgggaagcgtggtgctggcactcaacttctagggaggcctcaagaagcttacaatcatggtggaaggcaaaggaggagcaggcgtatcacatggtgaaatggagcaagcaagagagagaagtgtgagggttgctacacacttttaaatgaccagatcacgtgagaactcacaatcacaaagacagcaccaggccatgagggatctgctcccatgttccaaacacttcccactaggccccacctctaacactgggcattacaattcaccatgagatttgggtggggacagatattcaatgtatattgaagcccagcctcagaaatcacagtgtcatgttccctacatcatactggacacaactgtagggtcagcccatatttgaggacagtagaaatagaccctgcttcttgatgggaagagtggcaaataatttgcagctagttccatgatacaaccttttctgacattttgaatgccataggcatgtgggagcttgggatatactatgattaagtattatttttatactattgcaacttctgctttgaaatgaacatcttaactggatgcttttgtttgaattatttaaaatttattgtcaaatgcaataaatttagtgcaatgagaactaagagtgcctcatggcttttgattacctgcccttccttttacatttgtgacattattgttcagtttttaaattatcgttgataattacttaagaacaatttttttcaatatggtataaaaaatggaatattaagtgtccactccaatatcagtctgttgttcttagaatgaacatctccacttcctgtcaatgtttattctccaagagtgccttggttttgcacttacaggttatctatcagcaatagttataagaagatatgctagagattaattcatgtatttacttaattacaatctcctttggaagaaattaaacccacaaaacatgaaataaaaatttgttttttaatgtggagacaaaagggagagcacacaatttttttttttatttttagtagagatggggtttcaccatgttggccaggctgctctcaaactcctgacctcaggtgatctgcctaccttggcataccaaagtgctgggattacaggaatgagccaccatgcccagccatacaaaagagaagaattttttaaaactggctacagtcttcaaattgcttttcctgtatcccaaacttaaagtgctgataaaatgccttttaagttttctgttagtttctccaggaaaggtggtatctgacataggcccaggttggaaatgcttacatgttattaagcatttatgtaatttgggaatttttatcattgtcaaagcatgctagaagcatcattctttcagctgcccttagaagttgcttctagaaatctgctttaaaattgccatgtgaaaggcttatttctgctgtataaaaaataaagctttctttccattgcaaaatggcagtgtctgtagattgttagtagaggtgttgggttggacatgactgctgttactgatcaggataggtaatgcactgtgctttcttaaaagagcaatattagaaaactgcagcttgattgacagctcagcatactgaaaatcttaatgctaaatttgtttaaaaatatttggtggaaagacattataaaacttaaaactcagggttcaaaatttctccagaatatttttgtctactctaagtatttgtagtaccaaagcataattggtcaccattgccatttgaaacagcaaattaccttagtgtggtataatggtgtccctctgaaaccctctggatattttagccacatctgaaaactcagcatgtggattttaaatattcttgagaggaagatagaattctgaggcataattttagctgaatttgtattggtaactaaactctcattaagatgggttgccagattagatctgagctagggtgtagctgccacacctttgtaccgtgtgtagcacaaagaggtgcagcccttgtgatcacagagtgttctaaattgcataatactttctaaaggcctgtagcaatctcagtgcatttcttaaattctatgagtgccccccatttactttgattttatgttggcctaactagatggtttgtttctctgtttagttttggttgctggtttattttggagagttcacacttcactgggaaagttttaagttttcttgtatagaaataacttggtaatgttacattattagacattattataacaaactcttgattatatggcatcagataagcttgtttatggattgattgtaaaaactctgaaaaatgtaaattcttagaagtcatcaaaaaataaacacattaaaataaatctgttatttggaactctatagtaaccaacaaagcccagattctctctattgcacagttggcacactctttccccctcagaaaggaaagaaaaaaatacaggtttagtatctcttatctggaatgcttggaaccagagtgtttcagatttgggattttttctgattttggaatatctggttatacataatgagatatcttggggatgagacccaagtctaaacacttaattcatctctattttatacatactttgtaaccataacttgaaggtaattttatacaatattttaaataattttgtgcatgaaacaatatattgaaccatcagaaagcaagggcgtcaggcatcgaattttccacttgtgatgtcatgttggtcacaacaaaaagtttcgaattttggagcatttcagatttttagatttttggattagggctgcttaacctgtatattggaaaggaaccctattcagttattttgtagtgttaacttttgagttaataagtctcctctattaggatgatttcttttaacttgatcataagcatgcctcttaaatggagagtaaaaaacaataaaaaaaactaaacttagaaaaaaaaaaaacttgaggacttttcttcctccctttttcctccatctccagtccctcactttatgggaaggttgtatcatggtttttgggtatggataactttattaacccaccattggtagaatatgcactggagtggtaatagattgtgttgagaccattaacaattatattttctcattcagtccctctcccacaactaccagtgatagttgttgatgtgattagtgacctctatggtcctgctacagttatgtatatctttgtacaaagctgactgtatactgggatggaactttgggatagtgactttgttattatcttgtcactgatgttagaaatagggacagactctgcagccaaaaaaaaaaaaaagtgaaacacaattctgtagaaatggaattttctacacaggaacactgttaggaggtttttcttatatgttcactagcattttgggagtcaattcattatttttgtagaacaggagcgtgaaccacagagggaagaaaaataaacccaattgattccaagaatttaaaaattactatcaacattataatagttttaaaaattgcatagctattctgatgtcttctagcaattaatgccaccaaacttatgggagaagtctttttttctctctcagaagtatgctgtttttagcatttctgtgctttagtttttcattagtttcaagtactttttcctctttataaagtatgctgttttacatgagcttttctataaaaataaacataagcaaaaactacaatgggtttttgttataatagctggctattctactcatattctctctaagattcttgagttgctttaagccaacaaccgaaatccattattagaatgttccccctgccaggtttttattactaatacattgtttatttttaatcatcttttgaattattgactattttatggtgtctcataatagcaatttctatttgttttatgtacttcatagagtagattttgtttttctgcctcactccattatatataatggcttagctttgaaatctttgcttgatatagaggatgttaatttgctttaacacattactatctaaaatagctcaggttttgtatggtcttgtaaaagctttatctcgaaatgctctgaaagatgctttattttttactctctatttaaaaaagaagtttaaatttcctcctgatattcttgtctcatgccaggatattaagcagatgctcagattggctcagctaggtgatattaaaatgtatagattcagatttcaaagcaattaataactttcactctgacattattcttccaatattttattcctactccatgacctaagtcttctaacggttgttttgctacttaatctctagctaattatttcttttctcctcatcctgactgcattgagtgataggtctgttttctgtaggcttgcctgcatttcttaactgaacccctagagtactgtgtcctatcctactctcttcaattcttccccaatgaggcatgaccaagagattgttgtatccttaagaggcaaattcttagaatggagtggcagatggatatataagaatcaccagtgcagtgataatggaaattcaacttcaattagattttaaagttggttgcctccaaaaagtctagaagtgaattgaatagagctatttgccctattaggattttgttccttgctaccaagttgtcaggggaggtgattacaaaattggaggaatccatgattaggaaatgatgatgatgatgatgatgatgatgatgatcatggtgatgatgatcattgcagcctacgtttatcaaaacttattatatatttggcactgagttaattaagccttttatgcactattttgagcatctgttggttgtgcttaatattaataaactagttttctattactatgtaataaattaccacaaacttaggggcttaatacaacccacattcattatcttagtttctgtgggtcagaagtctgggcacaactcagttgagtcttctgtttaggttcccacaaggctgcaatcaaggtttgagccagggctagattctcatttacaggctcaacttagaaaggatctgctttcttggtcttctggtttttggcagtattaagtttcttgtgattgttggactgagagctttattttttgttgactgctagccagaggctaccctcggctcttagagatcaccctcagttccttgacatgtggcattttccagcatggctgcttggttcctcccagccatccctgggagagagaaatattcctgaaggacagatgttacaatcttatataatgtaatcatgtacactgatcatcaacaatctatcatcttttccatattctattgcttagaaataagtcataggtcccacccctacttaagaggaaaggattatacaaggtgtgaccacagggaggtaggaatcaggggcattaccttagataaggtacaccctacaaggtagggtgtaccttgtacaccaccaagagattgctatttgtcttccaatatctttccttcttcttccccacctgagaaatagaactactaattcattattagttaaatatatggtcacctggaatacagagtttattccctagtttccctcgtagctaggtatggccattgtgagtaagtgtggcagaggagtaagataaaagagtctaggactctgaggattttgtgaagttactctatcagttttttgaagattctttactcctgacttctttcaggtgagagaaaaataaacttttattttgcttaagccattgttatttttggctgtcccttgtaggacacctcctttagaccctcctctgctggccagccccagaacagggtgtcttatcctggtcctgcccaagtgtgatcaccctgtgggacaggagctggtctcttcagcccagcctctccatgaggaaaagttcacttcttaacaccatgggaggtgaacccaatcttaactttgttcttttctgtcatctcttctcccctttcctcttttcaagagcccttcatttccattttgtagtgtgtgtgtttttcaaggaacttgaaatcaccccaggtccaggtttaaaccaaccaggacattctgttctctgactcagtggtgaaagcatgacatatgccagtctaatcagagtgaatcttaaaacatttactgagaaatcgtggcaatacttgtatgtagtgatagttctgagtaaccatattttccatgccagccgccaattctgtcctaaggagaaacagactttacctgacccttgagcctgttgcttgacagagatggctcatgggacatataaacaacccagctacttccttatattaaccaatatttagggggtagtctaggggaagcttccacaccagccctgaggttagaaatagcatgtaagggaggactcagagaattgctctgtctccttgactgcaacagtattagtcatggctgactcaggtagaactgggggactctattcagtacagatcttagagaccattgtgtgagtactaagatttggtgtccctgtgcttgtggattcatgcagatgtcacaggatattggaatgctaaagtgattcatcccgttcaagtaacagatccttcctaaattgtctatcagtctccacacctataatcttgaatttattattactttaaaaaattacaaaagtaacccttgctcactgtagtaaattgaacaatacaaaggtgtggcctctgtgtaaaacagatgcttgctttctcaggaagtcttctgcccttcagtgttcctttcacatactccttttagccttacattgataaaatgtttactttttaaaaactaacattgattcaatgcttctcatagtctgtttgtttgtttttgtttttgagacagagtcttgctgtgtcacccaggctgctggagtacagtggcatgatcgcagcttactgcagccttgttctcctgggctaaggtgaacctcccacctcagcctcccaggttgctgggactataggcgcatgccactatgcctggctaatttctgcatttttggtagagacagggtctcactatgttgcccagtctggtcttgaactcctgggctcaagtgatctaccagccttgcctcccaaagtggtgggattacaggtgtgtgccaccatgcctgactctgcttttcctgttcaatatttcaatgattacagggttttaaaatatttttgacctaaacaaataataatttattaattccaaaatagataaagttgtcagcattctggagataaaatcaaagtaaggattcactagtttttccccagtaggaacttaacagttaagttagggcatgaaacgtttaaataagtcaaacagtgagggagaaggtgctaatcatgcactaaagaaagtgaaaaggaaagtgcatctgtttttggtttggcagttaccaccacagctgttttctagtgctgtatgtataaaaagagaaggcaatgatttggaatggtcattacctgggtaacaaaataatctgtacaccaaacccctgtgacgtgcagtttacctatacagcaaatctgcacatatacttctcaacctaaaatgaaagttaaaaaaattaaaagatagatacatagtataaaaaagaagtttcttaaaggagagatgggactgaagttgggtcttacaccaaacaagggaggacagagagaattggggctgctttaagaatcttggcccaaaacagagcagctgtcctcagacctacctgagcacccaggccacagccaacctcagatcaaaagggatggaatctcaggagactgaccaaggtagctgtatttttttttttttttttttgagatggagttttgcttttgctgcccaggctggagtgcaatggcacaatttcggctcaccacaacctctgcctcctgggttcaggcaattctcctgcctcagcctcccaagtaactgggattagaggcatgtgccaccacacctggctaattttgtatttttagtatacacagggtttctccatgttggtcagcctggtctcgaactcccgacctcagttgatccacccgcctcagcctcccagagtgctgggattacaggcgtgagccactgcgcccagctggtagctgtatttttaacatgctctttagataatttcgtctgaagactggcatttaggagtttctaaagcaggtgtgtcttgttattaaataagcacagctgcttgaaaattagtttgggaacataatttatgactaaaagtctttccaaaaaatcaaacaaatggtcatgttcatattagttgatatatttgttattccttaaagacatggttttgtacatgagttgctattctcttaattcttaagattctgtggaatcatttatttgtacaagttgtaccaaaaaggaaaacaagagtccacagaaataacttttttatcattgattgattcattctccatttatttgtttattcctctgacaaatattagataagactagagtcaaaaaggatagaaattagaacaggacattcatccagtcctagggaattttagtagagattatgtgaattaaacacaaattaatgtaaggaaaagtgccagagaagggagggattacttttagctgtgggaatttgagaatccttttagaaacattttgagcttgagatttggacataaatgtgtgtaaaatttgagtatttggacacaggtaaaagatgttccagacagaagatacagtgttaacaaaagcctctgcatgggaaatccgtggcttcccaatagaggaggttgtgctctttgttttgccttaagtgcaagatgtgtggtgaatgagagtgatatgagtttgcaaatttgataagtattatgtatttgccataaaaaagttgaaactgtggctcatgttttcatgatcaacaagttgaaaatcttgaagggcagaaagtagtagcagtagtgagctgccacctttatatgccttcacatttgtccacaccctgttaacattccacatgtaagtactgaaaaagtactgcactgactgtttctgcagaaagcaccacttaataccctgaataaagcttgtctctcatattttaggaatgtacttttaatgcttaagaattactttatttttctccttacctattacgtatcttaggttggattccctagaaatagaccctaaaatggcaatttttaggcaagtggttcactaaaggagtgctctcaagagagtcctgtaagacagtgaggaaagcagaatagcacagggaggaaagctaagcaaaggtgtagttttccctgaagtctagccttcatctgattccaatgggagctgtgaagcacgaatagcatctcagaattgtaggacctacaggcatcttgtattcttcccttttatcactcattcattgcctaaagctatccctggagggagggcataacctcccaacttttcccagaaaggcaactgaagacaattctctgtagaagggtacagctcttactagccaacactcatacagctagaagatgaagcactacaggtaaagggcagtggttctcacctgggggtaattttgtccttgggagacacttaccaatgtctgaagatatttttaattaatgtgactcggggttgggtggaggtggtgttgccactggcagctagtgggtagaggccaaggatgctgctgaacatatgcagaagaacttttctacaacaaagaattatgcagtccaattgtcagtagtgctaaggttgagaaaccctgggtaaagggagtctgagtaggacatcaacagtgactgctgcacctttctttttatgtatgccctgggctatatttgtaaactgcagtagcaggagccattcttaagtattgaccagatcaggtgaaaaaaactaaaagctcattcattcattcatgctttttgttttgttttgttttgagatggagtctcactcttgtcgcccaggctggagtgcagaggtgtgatctcggctcactgcaacctccgcctcccaggttcaaacgattctcctgccttagcctcttgagtagctgggattacaggtgcctgccaccacgcccagctaatttttgtacttttagtagagatggggttttgccatgttagtgaggctggtcttgaactcctgacctcaggtgatccgcctgccttggcctcccaaagtgctgggattacaggcatgagccacagcgcctggcctcattcatgcatttattcaggagatgtttcattaggtaattaaagaacacctgctatgtgccaggcactaggctaagcagtggggatacagagagatagtatccgctcttgggaagctcagaaaattaagaactaagagacatcataacccagtgactttgtcaagtttaaaagagagaatatatattaacacaatttgtacaaacttaaacataaatattcaatcatttacccaacaaatattattgagcacctactagataccatatgctattctaggcactggagatatagcagtgaacaatagggaaaaagtctttgccatcaagtagtatataatccaatgggagaaacagctaacaaacactcaaataaatatgtaataacaatttagataaagataagtgctttgaagaactcagaagaaaaaagtagaatagagagtgaattgaggcaggggctgtgggtgccttatattagtaagaatgatcagaaaaagcctctttaaagagatgacagttcaggtgagaccttaatgacgagaaggagttagccatgtgaagatctgggggaaaaagatctatttcaagaagatgcttggcttcatggagaaaccaaaactgttgctagatgtgcgggctggggagtggtaaggtgtgagttcagagaggtgagcagggactgcatcgtggaagcccactagaccactgtaaagagtgtggactttattcttattgcagtgggaagccattggaggtttttaaggcagcattttggcagatgtgtgatagtccagcaaagagatccaatggaggaaaatgatcaccaagaaggacattatgtgcttgccagctgagtctttgacccttcccaaagtgcattatagagtgtctttccattttatttcataactcactttcctaggtaaaatatctgccattggaagagtatgaaaatatagacataaatttaacattacaccttttccagcagcattgcattatttcaaaaatggtgaatgaatattaggtttgagttttaaagggcagtgaatcatttgttatgcccaagtcccaaatcgggacacatcactagaaagaggaagcccatcagattaatgaggaaagttagatattaggtacctaaactgtatttggtgtagtgtttcaaccaaaccaaatcacttttaacctttttatgtatgtaagtcctcattttgacagatgtagcagcataggctgaacaattattgaataatgtatttctagttagtttgggtgtatgcatgtgtgtgtgttcatgcatgtgtgtgtgttcatgcatgtgtgtatagcacagtgactagaggattgaatttctgttaggggataaataaaaagcctactagatgaatagtttgtagaatgatttttgagagctgcttggaacccagagtttacagcctaattacaatcttctgacagacctttagtgagcagtaatcatgaggataggcttgacttgagtttgaatggtactgttgtttattctgctgttcacagagagcagcatataaaatggattattttgtgtgttagtattcttttatgtgttagtagctaatgacatttttgatacattaataggaagcttgccagaagcccaaaggagcttgaatattttgtaggcaagtaatttatttaaaaattagctacggcataacgtgtatatcatagaagcaaacaacattattccactagtaaagagtaggcattgagatgctcttttgatagaatccttttttaagaagtattttcagagctcataaattataaatttggcaaatatggagctcttttaagttgatttttaaagtgaaccatatgtttagcaggatttctaattgctgtaaatgtccattgatgaataaaaatgagtaagcaagttttcttttttaccatacctggcaattttattaatgtcttacctaactgtaaactcaatagtagctgtttctgacacagaagtgtcagaaacactacttctgtgtcagaaacagccagtcagtggcttcccactgactcatcatccaacttagtaattatcaattcatggccaatgtatatacccatgcaatttcacccttaactatatttttgaagcaaatcccagaaattatatcacttagttcataaattaatagaacctctaaaagataagaattgggtttgtgtgtgcacgtgtgtgtttttactatcacaataccatttaaattcagcttggaaacactctttattactcttggggaagttaggaaaacgacttgtacttctttccatgaaggtttaactgctgccagaatttctttcctgtaataaaaaactagaaaatcaaacacaaaatatgtaacaactgttttcagatagcagacaacaggcaatgtaggactgtgagacctgagaggagggaaatcaataaggccggcccaacaattgtcccagcttcctctctgaggctgatttcaggccaaggggcaggaaggagaactgaaacagagcccagccaactcactgaattgaggaggcggagactggagttaggggaaacccactgggatttgcaagacagaatatcattaggaggggactgtgtgggggggctggggggagtggtaatacctggtgctaccattctgtaccttgctctttttaacttaacaatgtatttatttattatttaaatgttatttgtagagtttccaatatgtgcccaccctgttctagatgttgtggatgcagcctgccttctgatgtattgtcatctcacaagcagtagttccagatttcagtccaactaggaagacactgtgcgactgagtctagcactaagtttactctatagaggataaaacttttattgcacatgttactgtctcctagaacattagctttcaatattcaagaattgtagaaactcattaggtatgctgagctctggtcccaagtcagaacagaattttgaggtactattcttggcctgtcaattactcaggctgattctacttgcacatcaatagagtagtttcataatctactgtgattcaatctgttggaatcgtctatctatatggaaacctagctagaaggacatgtaaataaccatgcattttctcatcataaagccaggaccatgcttattgtagtttcagttgcagaactattttgcagccatgcccatagactatgagtcagtttgaacaaattatcatatttataagcttgctataattaatacttaggatacaatgaccttgggaaaattcgatatcatctgctacatgtgaagatatgaatatctaaagattcagcaattctatccctagatgtgtacccaacatatttatatgtgtgcatgtgcatttagagacatgtacaagaagttcatggctgcattattcataatagctcaaaacttaaaactacccaagtgtccatcagcaacaaatacataaatatattttggtaaatcatgtaatggaacagtacacagcagtgaaaatgaagaaactacgtgtatacataacttatgtgaatcacacaaatgtaatgtttgcgtgaaagaagccacacatgaaaatatgcatggtgggtgattccatttgagtaaagttcaaatacaggcaacattaaagtatagcttgaagagatgcaaatttaggtaaactattaagcaaagcaagtaaataattaccgtaaaaatggggattggaattacttttggtcaaagattgtaattacaaagcagtgtgtgctgcacttccgggagtgcttgcagtgttctttgccttcacctgggtggtggtgtaaaagtattcattctaaaataattgatagttttatatacctatacacatatttcattttattgtccttcactttattatacttcacagttactatacttgttgcaaattcaaggctgatggcaaccctgcatcaagtaagtctattggtgccattttctgaacagtatgtctttccttgtgtctttctgtcacattttggtaattctcacaatatttcaaactttttcattattattatatctcttatggtgatctgtggttagtgatctttaatgttactattgtaactgttacaaattgccgtgaactgagcacatataagatggcaaacttaatcaataaatgtgtgtgtttcttcttactgctccactgactggctgtttccccatctctgtccctttcctctggcttccctcttccctgagacacaacaatattaaaattaggccaattaataaccctgcaatggcctctagatgttcaaataaaaggaagagtcctatgtctctcacttaaaatcaaaagctagacatgattaaccttagtgagaaagccatgtcaaaagccaagataggccgaaagtgaggcctcttgtgccatacagttagccaagttgggaatgcaaaagaaaatttcttgaaggaaattaaatgtgctactccagtgaacacatgaatgataagaaaggaaaacagctttactgctaatgtggagaaagtttgagtggtctggaaagaagaccactagccacaacattcccttaagctgaagcctaatacagcataaagctacaactcttcagttctagaaaggcagagagaggtgaggaagttgcagaagaaaagttggaagctagcagaggttggttcctgaggtttatggaaagaagccatttccataacataaaagcacaaggtaaagcagccagtgtcgttgtagaaactgctgcaagttatcaagaagatctagctaagaccactgatgaaggccactaacactaaacaacaggttttcagtgaagatgagctagccttctattggaagaagctgccatctaggactttcatagagaggggaagtcaatgcctgccttcaaagcttcaaaggacaggctgactttcttgttaggggctaatgcagtgggtagctttcagtttaagtcagtgctcatttaccattctgaatatcctagtgctaataagaattatgcttactctacccttcctgtgctctgtaaatggaagaatgaagcctggatgatagcacatctgtttacagcaggttttctgcatattttaagtcctctattgagacctactcctgagaaagaaagattattttcaaaatattactgctcattgacaatgcacctagtcacccaagaactttgatggagatgtgcgagaagattaatgctgttttcacacctgctaatacaacatccattctgcagtctatgtatcaaggagtaatttctagtcttcgtatataagaagtgcatttttctggctgggtgtggtggctcacgcctgtaatcccagcactttgggaggctgaggcggctggatcacctgaggtcaggagttcgagaccagcctggccaacatggtgaaactccatctctactaaaaatacaaaaattagctggatgtggtggtgggtgtctgtaatcctagctactcaggaggctgaggcaggagaatcacttgaacccgggaggcggaggttgcagtgacccaagattgcgccattgcactccagcctgggtgacaagagcaaaactccacctcaaaaaaaaaaaaaaagaagtgaatttttcttaagactactgctgccatagatagtgtttcctctgatggatctgagcaaagtcaattgaaaactttgtagagaaaggagtcaccattctagataagaacatttgtgactcatgggaggaggtctgagtatcaacatgaacaggaatttggaagacattaattccaacccttatggatgactttgaagagctcaagatttcaggggagaaagtcactgaagatatggtggaaatagcaggagaactagaactagaagtgtatcctgaagatgtgactgaattgctgtaatattatgataaaacgtacatggatgaagagttgctccttatggataagcaaagaaagtggtttcttgagatagaatctactcctggtgaagatgctgtgaacattgttgaaataacaataaagtatttaaaatattatataaacttagttgataaaacagtcgcagggtttgagaggactctagttttgaaagaagttttacagtgggtgaaatgctatcaaacagcatcacatactacagagataccttctgtgaaaggaggagtcaattaatacagacaatttcattgttgtcttattttaagaaattgccacagccaccccagcctgaaattgatgcaagaccctccacctgcaataagattatgagttgccgaagtctcagacatttattggcatttttagcaataaagtattttttaattgagatatatacatattttaaagatataaggcatattgcatgcctaatatacctcaatgtagtataaacgttaacttttatatgtactgggaaaccagaaacgtgacccactttattggcatattctctttatgggtgaggagttgcttcttatggatgagcaaaaaagggtagtttcttgagatagaatctactctttgtgaagatgctgtgaacattgttgaaataacaacaaaatatttagaatattatatacacttagttgataaagcagtggtagggtttgagaggacttttggtggtctagaaccgaacctgcaatgtctctgaggtatgcctgtacatgggaattattttttaaataaaacttaaaaacaaaccctgaccataactacttaacctgggaattttctgaatattaatatttgcaaagtacctttcagtgtagaagggataagattacttgtggaatcctctgaacagaaagaagaggcatctgacccaagatttaatttcttacatagtgaaggacttccttttgatatatacagagaaagaccagttaattgagattctcgtattctaaatttcacattttttttctgtgttagactcctgtatttattccaagaagctcgatagaataatttaggattgtaatgtcacatgcaggtgcaatgtgacatttctgagtcatgccttggagctgacagtacaacttttccccacccccatccatagctttttacctgtttctaaggttttctaaatcataaagatgaggctactgatagtttgagtgaggcttatcaaatcctgtagcttattacatggaagagatggatttcacctagaagtaaaactttcgtttactgataatgataacagctaatgtctgttacaacatcgctacctcagagattttattatgtatcacacattcttttatgtgcatacttgcattagctcatgtgaatctcacaactattcacaagtattatttccattttagtagtgaggaaactgagacccagaggagtgccttgaaaatagatgtgtttgactccaaagcccatgctctttattgctgggatactttataatgctttcgtttagttcagggtcgcaaaagaaacaaagctcttgggtttttgttgttgttgttgttgtcgttaatggtacatttatttcaagtggaaactttagaaaattgacaagcttttcactcatgtctcactgatgtcttccatgtgcctttgagtcttccttggccagtcacttatgtttttaagtaggattcagaatcagaggtggtcacaccacctacctcaaaggctgattcagcttcggactacatttttggactaatgtttaagactcagctgggccaggctcagagtccatcctgtgttttccacatctgatttcttacatagtgaaggacttgcttttgatatatacctagaagcagccattgaataaaagaccttggatgtaatgcaagagaatggggcaagcagaggaaatagttgaaagtttgtagtgagccatcattgtcacattagacctttgtttaaaaaatgtatccattgttaatatttctacttttacctaaagttaggtgacagttataaggaaaagctgtggccgtcttaataatagctaagatatattgagcacttagtatgttccaagaactgttacaagactttttacctattaatgtagttaacactcgccacgatcctatcaggtatgtattcttaattctcctcattttcagaaatggagttggaagcacagagcagttcctaatttacctgagatcacacacctagtaggtggtagacttaggagttactcaggaaggctaattctagaacccacacatttaaccactatgtcatgctgcctcttcttgagttgaagaaagatttgcatgtgaatatactttatatttttaaaaaaatgaaaggtgccatggcatctcaggtgggaaaaaataaagaaaaaataaaaaatgaaaggatatcaagtgttggtggcatattgaatcctttgatttatttcaacataaactatctgcactggtagaaagacatttatagtttggtcgccttataggttataaggcaataaacctcatactgtaagtttataagactgccaagcattttccaaactcctttcatgtctatgaaccactgaacaacaaagatcaagtatgaaaaaatgttcttttgaatttccctaaagcaagaacatactgaaatgaatggtgaatagttggttccttgtcattccttgatcaaataatgaccttcgtgtctattgattctcacttttcttttgaaaatagagtgtttttattctaccaatgatttaaactagaaaattattattgctgtccccttaaagcattacattttttttaactaaaatgtcttgatgttattgatttaacctgtttccctcttttgaaatagctgtgtagtcctcttaatgtatacaacatagatttctggaaagcaattcatatatacttataaaatatgaattctattttaattcagatcttttatgcataactactgtgaaatctgtaagttctcttgatttcctttctttggattaaatctttttcttataaaaatgtagaaaacaaattttacctttattaggatagatagaactatgtacagaaagtacagtatatagttttctgttgctatataattactacagaattactgtcttaaaacaacatgcatttattatctcaaagttctgtagatcagaagtgtagctggcttctctgctcagagtttcacaagactgaaatctagatatcatcatgctgggcttttatctggagtctctggagaaaaatctgcttccaggagcattcagattattggcagaattgagttccttgtggttgttggactgtactccctgttttcttgctgactgtcagcagagagccgcctttagcgtcatgcagccctctccatcttcaaaggcagcaatgacttattaaatcctttttaggcttggatattctctgacttcactttcactcacattcaaagggaggatgttataaaagagtgaaaatcattggaagtcattcttagaattctgcctaccacagagaggtagcaaagtatttatgagtttggtacttccttgagatttgatattgacaaagcctgaaataggcgacttgctttacatgagtgattttaatgtccttatacctattgatttttcaaagggagtacagcacttttaaatttattattattcttgcttatgttagaattcagacttggaagtgttttttttgttgttgttttttttttagacggagtttcactctgtcaccaggctgcagtgcagtggcgcgatcttggctcactgcaacctccgcctgccaggttcaaatgattctgtttcagcctcttgagtagctgggattacaggcgcgcgccaccatgcctggttaattttttgtatctttagtagagatggggtttcaccatgttggccaggctgctcttgaactcctaacctcatgacccacccgcctcggactccccaagtgctgggactacaggtgtgagccaccgtgcctggccggaagttatttttaaagtggtgaaagtataaaattattttgcattcactgaaagattgttaaacattcgtaaagaaggtggtcttctaaccctgattccaaagttccttcctctgatgtcagtggagaggtggagccacttactatggcttatatttatggtaaaggcagaacatgttgagaatgaactgaatttcacagagaacttatcttttcaattttcttgctttagggtcacatagctttgctatgcggcattttttcaatgaaactgaccaccagccatttcttataggaaatgcacaaggcctcaggcagcaagcaacagctgaggggatcagcggatcttttaatctgcctgacgctggccgtagagtccttgcaagcatccaccacgccccagagagcttgttttctgaggtggtagaagggccacatccacagtattcacatcccttagatcctctctctgggaagccacagtggtgataaatgtcgagaagagcagttattctcagggtatatgacctcacagccaccacagctcatctctgctttatttggctttcattcattgaagagacagattttgagcaggaagtacatcttgcaagtactgtctaattactgattaccctctttctgactccaccatgtgagaagcccttcagctgacccgtttcctttataactagtacttaatatgcatcagatttgtgcctttttaagttttatagtcttccagttctgcatagttccaaatatgtctctttagtgaatcaagcctccctgacaccactccctgtgtcttccaacccacagcccccaatgcatttaaaggtacattcagcagaacaaaatttcccaatagagtcatacagtggcttattcatagtgcacactgggggtcttctaatgaaggatagagggcacttgtgtcatggtatcttctatgattcttttgtgtcaaattcaacatctacattagtgcccccttgaaataccatgacctcttagctctacaagtctagtcttttatcatttaccagaatgaacacattttgagtgtctttattattctgtaccactttatttccatgataaagaaatgagaaccccttctttatgtctgagacctttccattctcttactacttacgaatgcaaactttcatgtcatcatacttttcaggtaagaaaatttccattatttctaatagaattgatgtctagattattttaatcatgactacctatccttggacactttatgtttatcagagctctctttcaaaggctcatctgaaccgaacataatattccaaacgtgttctgcccagcccagagcagtctagactgcttcctcccttgatgtgtggattatactttcccaggttcaggtagtatccattctgtcgccagaagacaagttaatgaatgtctaatgaagccaaccagtatttttaaaaagaagtctaagattgccttagaatatttagtagacatactgtgcctctggttcagactgaaattgtggttgactaaactcccccacgctcattttctttggtttgtttatttagatcattatacattgatgaattccacttctccacagctttcagctttaattccttcttgcttcaggttatatccaacagtttattatttcaaaagctctctgttagcctttttaagtactcttatctctgaactcctagtactgggtcaatccagccatctactccacacctaacctcaggctgctgagaactgctgttgaaaaatcacacaccttatttttgtctttgtcttttttatgtttttttttttttggtctgtataaaataagattgattacttttgctagtcagcaccatgatttaaaattttgatttaaacttgattagctgccccatattttcctcctagattgtaagcatgttccttgctctgggactttgcgcttgtgattacctctgtctaatgctcttccactagttgagtaattttcagtcttgactatatattagaatcaatggggactttaaaacagctctgatgctcggccccactccagaccaattaactcagaatttctgaagggtgggacccaggaattagttttgttttaaaagatccccaggtaatgctactgtgcactaaggttaaaagtcactaccctataaagatgcatgctttgccttctcactttaattggttttaagctcaaatgatcaccactttagggaggattttcctgtttatctaaaatatagacctctttcactttctattcccttctcctgccttatttttcttcacagaatgtatcatttatttaccaggtaagctattgttgcttattcatttcatgtgtttgccttcttctcacagaatataaccttcatgagtgcgtacatatatataataatatacacattatgtaatgtattatcaatggtgattagaaccaaaaacacaaaagagtggaagagactgacttggaacagtatatatagagagaagagggcctagaatagaaccccaaggaactaaaacattttgggagcccatgtggtggttactctatttcttgattggtttagttcactgccatagtccaccatctatagtagagcatggcatactattcaacaaagttgttgaaaggagttccccagtacttcaccattttcctcaacctcccaaataaattttctttttcactcttagaatatttttaaattgcagaaaaaaataaaaactgtctaatgaaaattctttaacattctagtccctttgaccaagcttataaagtgcccatgtatcttttttcgtatctcagaaaattgattctcctggtgtttgggggaaagattttgttacatattttttttttgttttgaattcctttattttggatcctgttccattctcttcatcttaagactttgatctattcactctctctcctttattggtgcctttcttcaacgtgagtctacttgtgtttctcccatttaaaactaacattctctcttctgtctctcttgctttctctctctccctgctaaatcctctcatttgtcttatctcttttcatttttaaacctctctatcctctcatttctacccctgatgcttcagcaaaagtgctctgaagtcaataatgatctatttttttccaaatccagtgggcactgttcattattcatctttcttgactttccctctattaagttgggaatgttgttaacttctccttttgaaaattctcttctttcttggtttctgtgatatccctctctcttaagtctgattctacctctaaggtacaatccttggtaagaaagtcatatgtgtcattattcaagttattgataaaaagcttgaaaaaattcaggcttgaggacaggttctgtgttgtgctgttagagacccacgtctaggttgttgctgatcaattttaggggtctgttattcagtctgctgaataacatgattatacagtctgtggatctccatctagtcctggaggatataattaaaaattgttaaatgttttaatgaaattatgataaaatataaatcatacaggattatacctcacagtaacacaaattttaacataaggcaattggcaattgatatttagggggtcttcaagccagcacctcattctcaaacaaggataagctaaaattcctatcttctagggagaggacaagttgtagagggtagcaaaacatcagacagctaggatcttaaaaatagagaggctgagagcaaacaagatcctaatattttctcttttcagtgtccccagattggttgacaaagcaaagatcaattgtatatgaggccattaaattactgcagctatcccaggagtgccagttagccatgacccagcattgtcttcttgtttaattaagctagaggagcaaatgccactatttgataccaaaccatagttggacttgagttgggtgttgattgctgcagctagaacataggtattctatacgcctcaaagtgtgaaccgtggactaaatgtaaacacacacacacacacacacacacacacacacacaattgactgttgagaagaaaaatgaattttattagtcagagagggaggtaaagtacaagtataaaagttatggatgacttactgataattgcttaccataaatttgaaaacttcagcataatctgagaatgagatggcctccatattaatttaataaagttgacattaaacttgaaatattaattcaaaaccaaaagggacctttgtatgtgtggttctgaattttggttggggaatagaaaaggaatctgaatgttgacctaaactcataacatggataggtgagagacagtcacttctttacctttcattttttcttcactatggatttgataaagaacttttgaaattttttttactacattggaggatgttatggacttcattcactttttcttcaagtaaaattttggtaaatattcagttttttaaattggtttgagaaactattgctttggggcaaagtctaaaataacaattgtagatctccttttagagctatgaaatttgaggttaataagttaatgtttcagaggatcataaaacagtaagctgagaagaaaactaagattttccaactttcagaagacactccatttagtaagccctatgttgtcagatgttgcctgtatttctgagtgagaaagaacttttaatattaccaacggtctttgaaatcttttggaaaaaaaagcagacaaattttttctaatttagctttattttgtaattcattttggtaaattattatttgcctccttttctagatttttcttttctagcatttgaattataatctcagaggatgtccttgatagtggaagtatggggttatttgtcatgtcagttgataattactttggatgatcttactgaaagctaaagttgattgtgttcatctgcaaagcaaacaattttgacaattaaggcataaaaattgtgagtgttacatatagctgttccaactataatgtgttgattagagctgtttcatgaatctttctcaggaacagtctgagtgctatatactgcttagaaagaaaatacagagtcagtgtatttgctctcacaatgtgctgattgcggcagcttgcccagagctaaactggctgtaataaaaacttctggattggaacataatgatggcatttatgttatttgcctcctgcactttataaacccaagcaaacagctctcagtttgagaacctcagaaagatctgtcattaggtatggctgagtttccttatgtcgattctttgaagaatatgtcagctgaagtcttgcagtgagcagtagaatatgaatcttacgtagctgaaggtgctagattaaaacagcttccatcttctgactttgtccagatcattttattgaactcagtttgatagatgcctttctgtgagggtgttattatttttaaagactcatagtgagttcctggacctttggatgcatattgccccctaaaatagcatgaaatcaggcaaactggacttattattagcatggtacttaagaaaatttgaaaacagttcaaaggaaaatgactgaacccatcttatacatgcagtatgttttaacaaatcaattgtggattagctctaggaagtggccgtgtttgtgtacatggaaggccacctagatctctgccacatattacagtgtctgttcacaaaattgtccctttttgaattcatagaaccatcactgggaatagcagtgcctctgagtgcctactaaggaacagttgtggagataggccaaagctaaagagagaataggaaagaaaaaataaagatggagggagtgggcaactggagatggaaagggtaaaggatgagtagcagtggttatgtcctgtctcttaataacaatctaatggaagagttggctttcctcttgctgagaaaggatatgcatttttcatatgcatatgccacccttcactgggtttcctgtgtatctttggatcatataccagattaacaggagttcttcattagtaccagtgaagctgttattatcatcacttagccttgctgctgtggacaatccttttgaagatctacatttggaaatggcacgtggaatttcagctcttttataatttatttcttacattattttttaatgaataaaatgaggattacccaagaccgagggacagtatgattcaacctcttcaaggaaaaagtttttaaatggccttactataatattcgaataacttagacccttcacgtaatttccttaaatggaggaatttagtccctagttatgaaaagaatacagtactttctttctagaagactgggaaagtcagaaaagtaaaaagaaaaaagtgcacctataatctcaccactcagaagtaaccagtcaggattagatataatagtcctaaagtgcctttgtattttctaaattcttggggcagtggataactgaaaaacctgaagttttgtgcctgttccctcgggtgatattctaagtaatacctgttatatgttttagtttaactcatgtgtctatggacagtaatatttgaatagctataatgactatgtttaagtctattttattccaaattcacgcatttagccagaaattctctgaccaggagaatagagagaattgcctaatgatttctctattttacctaatgatttcactgtattaactcgtatcttaaacagtaataactatacaaataaacaaaaaaatggacagatacataacttcttgaccacgttggctaatgaaattaataatgaactatgttgaaaactgtaaacatttgctatgctatagtttacaagtgttctccatttagtagaatatcagtgctatttttatgttattgtgctagtatttcctacacaattgttttgcgtgtgtttctactagcatatagattccagactcttcagttttagaagtttcagcatgtatggggtacgtgtgtggtgtgagcatgggggcttgctggaaaggaagttatttcctcttatcttttcttgaaaaaattcagatccatgcttgtgctaattttactcaaactataatttgtttctaaaaactaatgttcagaaggatcaaggaaaagtaatgattataccctttaatttttgtagttaatttatttgaatgttctaaaattgttagcatttttagcccgttaacaatgacagcagtgttgtaaataactgtaacagagctcttgaagaaccagacctcttgattaacaggacccttgatcctacacttaatgaactcctcaggataaaaggtaccataaaattacagtcatgtgctgcataaggacattttgaccaatgatggactacatatacaatcatggtcccataagattataatggagctgaaaaattcctatggccgtcataaggtcatagtgcaacgcagtactcgcgtatttgtggtgatgctggtgtaaacaaacctaccatgctgccaggtgtataaaagtatagcacatacagttatgtacagtacatcatccttgataagaaaaaatgactatcttactagtttatgtatttactatacttttttttatttatttatttttaagttaactgtaaaacagcctcaggcaggtccttcaggaggtattccagaagaaggcattgttgtcataggagatgacagcttcatgcatgttatttagtgggacaggatgtggaggtggaagaaaatgatattggtgatcctgatcctttttaggcctaggctaagatgtttctttgtgacttagtctttaagaaaaaagtttaaaaagtaaaagaaatgagttaatttttttttaaatagaaaaaaacttatagactaaaggtaggaagaaaggaaatatttttgtgccgctgtacaacgcgtttgtgtttaagctaagtgttagtataaaagtcaaaatgttgaaaaaatttaaaagtttataaaatgaaacagttacagtgagctaaggttaatttattattgaagaaagaaaaatatttttaaaatacgtttagtgtagcttaagtgtacagtgtttatacagtctacagttatgtttagtaatgttctaggccttcacattcactcaccacttactgactcacccagagcaacttccagtcctccaagctccatttgtggtaagtgcccgatacaggtgtaccatttaaaaaatcctttatgtcatatttttaatgtaccttttctatgtttagttatgtttagacacacaaataccactgtgttacaattgcttacagtattcagtatagtaacatgcggtacaggtttgcagcctaggagaagtagggtataccatatcctaggtgtgtagtaggctatactatctaggcttgtgtaagtgcactctctggtgtttacacaacaatgaaatggcctagcaatgcattttttgaacatatcctgtggttaagtgacacataactgtatgcatatctttttttgtttgtttttgagactgagttcactccgtcacccaggctggagtgcagtggcgtgatcttggctgactgcaacctctgcctcctgggttcaattgattctcatgcctcagcctcccaagtagctgggattacagatgcccgccaccatgcctgcctaatttttgtatttttagtagagacggggtttcaccatgttggccagactggtgttgaactcctgacctcaaatgatccaccccccatggcctccctaagtgctgggattacaggcgtgagccaccgcacccggcctgtatgcatatctttgttgaggacgttcttcctttctgtttaccactgttaccacccaaattatttcaatttttaagagtaggtttcttttccaattaacctttgtacactgttttgtgaattatactataaaatatgctcaaattgccctcaatcaatatttggtactgataaataataaaatattttctgagtaacaagtcattttcaaaattctcattttcattacataatatttataatacaataattctcttaggtggatgtgactgctagatattcttctccggttctgtgtttgggcacagcttcaactgactcagggattcttagcctgcctagccataagactcccctggaaactgattatgcatacagattccaggcctcacccctccaccccagacctgctcagttacaatctctgggtgacttgtatcatcagacaagtctgagaaacttgaaactagtgaggctgcactgggaatttgatcaatgcgtaattgcatgttggtgtataggaaagatttatggatgtggattgaattgatagtgttcatttacttttatcactagtcaaacatcataagagaaaactgctctcctactttctttaaattttagcttctatgagacttcagttgaggtaatataaaaattattttttgagcactaccatgtacaaagcactattctaatgtttttcatgtatctattactattaatatagagagacgaaataatttgcccagagccaaataagtaacatatgggaaaacttggacttgaacctgagaaatcagatttcagaatctacacaattaacccctgcaatatattgcctatagccaccaaatctaagtatgtattaatgtgtcaggcactactatattaagtacttcatatacttttagtacttttaattcatttaccaattctataaagtgggattacgaaaggcaaattcagagatattaagtattttgcccagagttgccctgctagtaagtggtagaagcagtgtggtttgaaattggggtagctcaactccagaactcttttcacaaccactatcctgtacgccagagtggcatgtttgaaaacactcatacttgtcatcccttcagtattttatataaatagtattagcacctgagtggttttctgtaagctaattatataacacttcattgtctacatttaaaaatgtctacatttaacatctacgttaagacactttggtgtgtacattaaatttttaaagagattctacagtatattatagaattctgtctctgagaaagatttgaatataatatattggtcactctgttatctgtcataggctggctgaaggagagataaggattaacatactttcaaggaattcttaaccctctagtttttatcattaaaggatagtatagttggtgaatacttgcgtattttgtgaacatttggtaagcagttgcacttaatttccttcacttgaacattaaatattccacatttgttctgtcccaagtaagctattctcctttactttgaaatgacttataaatttactttcacacaattattaaagatttactgtaaactgctgctttccccctccttttttttttttttttgtcccaaaatgaaggtgaagtgttaattggttttaatggcatctatggttacctctttgtctgggacttctaaggaaaagcgaagaattggcagaaaaatgtgtgaaatttgtctggggaggtgagaaactttaatgtgcttgtgaattagtgcacttcttctaggtaagactattgcagcataataaatattgaaacggaattctcactcttagacctaatcctttaagtatattagtagacatcatagaagaattttctgaagaaatatgttaactaagtttctgtagctggaaaagatcagcccttgatagactatgaaataagaatgtcttgtgtaaacatacatggacaaccagtgaatagactgtctctctcaagaacaaaggcatgctaatttggattcagaactagaaagaaggagcctggattttgcaacatgctgttatagttaaatacaagactatagttgcctgagacatgtacctggctgttaacactttttcccaataaaagtgattctaataccaagagtggctaattcatctgaaacactgttcctggtgcttatacactgatacattttagtaactctgtgcctttgatttaataggtaaccatctagataagtgttcttatttaacaaaaaaatgtactgggattctggaaagctcaaagaagacttctttaccattttaacagctttaagataactaatcttttttaaaaaattattattccttctgcattttagcagttgacatttccacttgtacctttaccagaaggcagcagagtaatgtaatgagcccagttctgtgttgggggagagagagaaaaatatggctttgttagcatttgcttctgtaaaatcaattcagagtacagtgggacaatagaaatgcaaacaaagtctgttgatttgtttctacacttccctctttttgtcattccatattgaagtgtcggttgtattataagataccaagaaaatgtttttttatcatcaaagacaaaaacaaaattttttggccgtgggcggtggctcacgcctgtaatcccaacactttgggaggccgaggtgggtggatcacctgaggttgggagtgaaagaccagcctgaccaacatggagaaaccccatctctactaaaaatacaaaaatagctgggcaaggtggtgcatgcctgtaatcccagctacttgggaggctgaggcaggagaattgcttgaacctgggaggcggaggttggggtgagctgaggtcacgccattgcactcctgcctgggcaacaagagtgagacttcgtctctaaataaataaataaataaataaataaataaataaaattttttaggcactttgagccattaacccatacccgtgagttaagtcctctacttgaaatacataattttttccacacaattagacaggcattattactaccttattttacagaaggtgaaactgaggcttagaaaagttgaccaaggccatatcccaaataagcagcaaaaactggaaagcaaacctaggtctgtctaattcaaagataatgctcttagtcattatctcaaatatgaattgtatatataatttaatagtgttctggtgtattttgttttatgtacttggagtcagcatgtcacaataaagagcaagatagaaaaggcaggagatctggagtcaagacacttggatttggaatcaacttgtttgttggaattctaattctaccacttatactgtgttatattgggcaagttgctttaactgtttgaactttggtttcttttgtgaactgggaagtaagggagataatggatatgaaatgcttaataaatggtctatgctaatactctacatttgcagagtggcttacggtttacaaagagctttcaccaagattgtctcaggtaatacttagtgatataagtgtttgaagttcattcattcttttattcattcatccaacaaatattttataagtgtccactaggtttcaagcattgttttacaagttggaaagatttagcagtgaaactacagggaaaaaaagactcttgttttcatggagtttgcattttaatgaggcatatagataataacacataagcaaaatattaaatatattagataataacaaaggtagcatttaactcttatatggtaagcactatgagctagtagttagcttaatagctagaagcatattgtgattcatagattagctacatgattttccattatagacaaacaaaacctgtaaagtacttacagttcaactacaaacttaaaaaattgtattgttttaaaacaattaggggatttaaaacaattaaatgttggtacacatcaccaaaattggtgaaatatcttctagctttaacattctatgatatattggctaaaagcatggagtaaatatgtacctcttatacctgtctgtctttatgtaggtctggcaagtgtactctgaatataacataacaataattcacagatttttttaaagattattgaaaaacacaaaataatcttggcatttgttaactttgtaagctagtcagtattctcttgagttgtatgtctcaacttcagcgcaaagctaggaaaaagcttcagtgatctgaaacttccattctcttgtactatggctcttaagaagatgcaatgggatcatgagcagatcttgtagggaacccagacattaaggttatttctgtctaccctgagtttaaattcactgaaagctacaagaaagacaagtgttacttttagggtagttgacagccattgactattgatgactccaagtcatcattcagcatcatggggcagaggtctgtaagtattggaagaaaaagtcacatctccccattaaacgttttgagatttaatcctgaaaatgctttctagttatctcagtaaaaggaaataatctttttttcttgactcaaacattaaaaaatttactgatgaagtatttctggtcagtgtttaagacaagcttgtccaactcatagcccatgggccacaggcagcccaggatggctttgaatgtggcccaacacagatttgtaaacttttttaaaacatgagttttttttgtgatttattttttatttttagctcatcagctatcattagtgttagtgtattttatatgtggctcaagacaattctccttcttccaatgtggtccaggaaagccaaaagattgaacacccctgatgaagaagttaagagcccaagcttcagtaacagaattcttgttctactacttactatttaagaagaaatccattatagcttcaaaatattttgagcatctttccacctctctactcaccaccactattctgttccacacagtgtttctccatacagtagctagagtgaccttattacaattgaaatctgacagtctgatccccacaccttctcctcctcttttacttacttctcctgctctccaccccctatcttccccttattcctccctgccctcttaaaaactgcccgttttctttcttttatgctagaatgaagttcagactccttattcaggcctaccttgctgatctcacctacgtcttgatcactgagtgtaagtcacctgaattcttctaatccttaaacacattaagctgatttcctatttgcaactttaacacagcctgtttcctgtgctcagaacactgttcattttactctttacatggctgactctttatctctcgggtcttaggctttctcttaccacccaatctaagtaggttctcttgttatgctcactcatagcaccatgtttttctctttcatggtacctatcatagtttttcactttatattcctttgagttttgtttaatatctggattcctgggtgggcacggtgactaatgcctgtaatcccagcactttgggaggccaaggcgggtggatcacgaggtcaagagatcaagaccatcctggccaacatggtgaaacccctctactaaaaacacaaaaaattagctgggggtggtggcatgcacctgtagtcccagctacttgggagtctgaggcaggagaatcgcttgaacctgggaggtggaggttgcagtgagtgagccaagattgcgccactgcactccagcctgatgatagagtgagactgtctcaaaaaaaaaaaaaaaaaaaatctggattcctgtcctcccccaaccataatcttcatgtctttttggtctactgctgtacacccaactccagccacagtcattgaacagatactcagtacatcattgttaaggttgaatggataacaaatctctatgacctttcgaagtcttaatttgcttttctgaaaaatagggataataattcctatctctaaagttattgtgtgaattaaatgagattaaaagatctaaaatacttaatgctgggcttgacaaagtcttcaacaaatggtagggtctgtagcagcaacaacgtaatcagcaggcacttattaagcccactgtatgtgtaagacgtcactaatatttatagaacatattttagaaagagaaactttttttagacttttgtttaatctagccttttctgggtatattcattaacattgatccccatattaaggaaattaaaatgcgagtttccagcagtgattccatgctttttaatggaacattgatatgaactagcctcagttttatgttgtcacaattatcagagcccccaacatacattcaacagggtattactttgtgtagtaattgcctagactatcctccctccactccagccagctggcattgaaaaagaagcactgcttttatgtgtgcacgtaatcaatctgtaaaatcccattatccccaacttccacacccccgtggctgcatgcttccttttgaagcctcttaaaaaagaaaaactttgaaggcaaccttgaagtttatttctaatctcattctagccatataacataaaaatgagataggggtagggagtgggaggggttcataatgtgatttgcttacctctttgcctggaatcttatgatacttgtaggtaagcccagtgaaagtttacatgagtaaaaatacttcttcagtgtgtattttgagataaagttggatttaattctgtttcaaagtgtgaagaatagagcaaggttaatgtggttattcttgttcttcttttaatctgttcttaatgtctatactatttagaataagagtttccacccacctcttatgaccagcagcctgtgtaactgattatctgttagagtcctaggtgcaatgcccttcccactctgctttcctgtttcatgtctgtttctttctgagaatattatctcccttctggatcattttctaactgcttttactaggccactgcaatctttttcttttgggttccaatttcccatgtgattggcatttttcttagcattcttcccacagtcttgaagtaattgacgtttttgcttgaggatgacctttcctgtttcctccatctctagaaactaccaacatttgattaaagtagggtaggggagaggtgtgggatgtaggtaggtaatctcaaaaatgttttctccaaacatgaaagatgtgactatgcttctgtcatcattattcaaaaacatttattctgaagtctgtattttatatatgcatcacctaatcccatcatcttctccatcctcttcatctctgggacatttccccatcttccttagagcctgaactacaaaccttaccttcataccaactcattccatctctctcagtgactttgttctcctagctagtgattcttgtaaaactgtagcttctcggtctttatttcaggcatcctagagccacagtcatggcttaggccgcacctcttgggcatctcaactttcttttctcctattaaatattcttcctgtcttcattgtagattcctctcactatactcccatcttcttcctcaggttgatatatctccctcctggtgttcacttcctttttttctatcttgttcctccccatgacccaacaagaccccttcaccctcttaacttcttgaaagagtagtcttaatcattgtttctgttttctttatctcccattatcctgtcagcaccctagaggcttttccctcattactctgcagacgctgctttcataatccccaagggtcacctcatttttcatattcagtggtgacctcttctatgtctttaccctgataacatttttgacatcctccttttttaatactttccttccttgactccataatattttctttctgtgattattttccctcctctgcaatccccccctttttgtttgttgtttctttgatgtggattcttcttcttcccctgctacaaagggtaagttctcctttggcacctcttttctctctgcttattttctgttgattatctcatccgccctctcaatgttaatactcacctcttagatgtggtttcccttcctgatgctgaggatatgtccccacatcctcctttgtaacattctgtagacatgtccagagggataatgtaaacctaaggtcatgttaatttattatctaaactgggtcactgtggagggttgaagagggcactattaataattagcagatgtaaacctgtactgcgcacatagtcacctgttcaaagccaacatttacaaaatactctgaaatctgtttcttctcagttgttttccatctttattaattgcctcaccaacattctacttacctgtgctgaaaatcttcatcatcttcaatattctactttttttactgtatctttttaattaaagctttcttttctttatttcttttttgaccccattccactggcagtgcgctgttcaggcccttatttccccttgcctgaaatactgcatagccgtctaacttgtcttcttgttcccagtttctcccattcatctttaagcaatattttttatttttataaaatgttgcctgaagtgcactgatcatttatatacctgcttaagagtcattgccaaagaatatcaatgcagacttctcagcttggaattcaacacactacaaagcctaatggaaaatatacctttccagtcttacctccttcatggaccctgtatttcagttggactattggcctttatccaaacacctcctaaatcagtggtccttgaccacatcataatcacctttggaatttttttttttttttttttttttttgaaatgtacatgcctagccttcatctgggagcttttaatttagtaagtctttactggggcctaatcagaccccaataaaacctcttaataaaaacctccctcaggtgattctgaccaaggccagggttgagaaacattgcccatttttatttctcgataattttggtcacattttttcttcataaccagtatgtgcttttctttaaattccttcttacccttcaacacctatcctatctccttcatgaggtcttccttgagctattcaaatagatgtagttgtttcttcctttttactgcagagcagtgaacggtcactgctgtttatgcctaataattggtagacagcacacttcttgaaggcaagccatctgctacttataaaaaagaagccagctgggtgtggtggctcacgcttgtaatcccagcactttgggaggctgaggtgggtggatcacttgaggttggaagttggagaccagcctggccaacatggtgaaaccccgtctctactaaaaatacaaaaattagctgggtgtggtgacgcaagtctgtaatcccagctactcgggaggctgaggcaggagaatcgcttgaatccaggaggcacaggttgcagtgagccaagattgtgccactgcactccagcctggataacagagtgatactccatctcaaaaaaaaaaagccagtcagtaaaagtcattgactagttaagaatatttgtagagaactttgaagttcttaaaaagtgattgataagcaggagttattttttgctaatttaacaaaaagtcccaaaacaaaaagtacggtgtttgtaattctaagactatgctaaattaagatttgttaatcatgctaagaaggaaaaaggaattagaattttaaatgctgctaccattttcagcagcaatgaactaatagtacattcattggtggattgattccattaacactcatgcttcagatgctttagggcatgtagctctctttggattcctcatgaaattgtcatgttggcatgtagctataaaatatgcattaatcagaaactgtagttactaaagccaagttcttttcactagtttgtttggaataggggaataatacttttaataaatcggccttcctgtaagatagagcacagtgtcatttttaatagggagcaagaataagtgcagtgattaaatgcagttacaaatggctgcatctaaaaacaatttttgatttttgtcaaacatttagcaagggagtaatttttttcctctagttttttgtagctttcccagtttttttttgttgttgtttttgttaaagttatatgctatatattcagaattggattctttttccctataaatttgttagtacctgatttggaatttagtcttattaatatcatttagtttgggatgcatggaaatgtatgtataattattgagtgccctttaaggtggagacttgtatcttgatattctattgaaatatatatatatatatatatatatattttgtattttgcaaagcaactggattttatagcaagcgtaggtaaagaaaaaacttgtatcctcttggtgctctgtgtatttgctagtataaaacatgtttctgatttattccaggcaacataatcaaaaggtgtattttagaacatacacaaacttttctatgctcatgaaaggtatactgactggaaaatatcaatataatctcttttttttttttttgctttttataaactacaggtttacagagactttatggagacatccagtcctttccctgacttctagcagaactatagcttaaactactcaaaacttctagaagcaaagtcaaacttccttcagaaacattccttatgtttaatgttaatcacattcatcttttaagttgtccctcgaaaacaaccataatgggaagccaaaagacagagtgttgggaaacattttgaagacagcaaacaaataattaataagatttcatagtcacttggagatatctccttgtcagtagaggagtaaaaggagcagtatctagtaaaacttgggaacagatggcaaacatttgttgaccataataatagtagtaacttgtattttgtagaagattatacagtttccatgcacatcgtgtcatttaatcctcacaaaaatgagggtactattaacccccttttacagatatggaaacatagctaggaagggtaagtagtttgtttttaattgcatacctaagtggtagatctgagatttcaagtcttttgatgctctgtgtggaaaacacaaactcaaagtgtgtatgtgtgtttaattctctcattcaacaataatcaacatagaagacttgtcttaacaagttttgccccatacaccacgcaagcaatcagttcttcagcagataccagctgggtgtcctccaattcagtttaatcccaacactgtctacctggaaattgtgtcatatcccacaggttgagggcttattcccacaaaactgcctcctcttcagacaccagttgcaagactagtcagcttcaagtttggtttcccaggatcccctttttgtgttctattaatttgctacaacagctcacaaaatgcaaggaaacagatttactgacgtattataaaggatgttacaaaggatccagatggcaggaaacataaggtgaggtctaggtgggcacagagcttccatgccctctccaggcatgccatcctgcaggaaccaccacatgttcagcaatctggaagctctccaaatcttgaccttttgtttttttatggaggcttgattacataggcatgcttgattaaaccactggtcactggtgatcaacttaatcttcatccacttcgccctctctggaggttagggtttggggttgtaagtcccaaccctataatcatgtcttggtcttttcaatgatcagactttatcttgaagctacctagggcctgccagctatcagtgaactcattagcatatgaaaatatatcactttgaagattgcaaggattttaggagttgtatgccagaaacagggacaaagagaaagtgtgtatttcacagtatcacaaatgccaactcactctactaaaaggctattttaaaaaaacagtttttcaaagaccaccttaaaaagtatcaggacagtggcagcagtgcgcctaagagagaaaggctttgaaaccatttcttaaattttccatctatacagtgtataagtaagaggaaatacatttatacatgaaacactgaactctttgaagtaaaatgatacacaacctcaagatgttgattttttaaaatttttagccaacttttatttttatgcctagaaaaatacatgggacgtttaggactaatgtgctgggcaatttgctacttagtgatagtaacacaatcctgaaaaagcaagcacaattattctgtactttttaaaagttttattcagcaataagaccataatttttcatatttaaggagtatgaaaaatttgtggagttttaaaagctgaatacatgtagcgttggatcaaggcacatacaagactggccaaagggcgtacaatgcactttggttttttgttgaaaaaaaaaaaatcatggcaacagaaaagtgatatggtttttcaacaagtaacagctcacaattcagtaggaagctagaaggaaatgttacattacgagttcattatataatatctggaaaattgtgacagtaatgggcagtattcttgatctttgtaaaagtaaattgaacatttatgtacagtgttaaaacctttgacataaaccagatctaaatttgatgtctagtatttatttttctttaaattatctcttatttaaagaactactttctctggattgttgaggggaatcgcttataattacattacatttttaatatgcataaagtttctctgacatcctttatgataaaaacatcataaacactaacaattttgtgtttataattcacttttcaaaaatcaggatggtataggcaaaaccaaaatgcagttttggtatttgtgttcattacactatacaagtctaagtttccatgttttcctaagtacacattttccccccaacttggaagcacatttacattaccgtttttgtgaagtcctttattttcaaagctttgctgacaatggctttaacagacttcatgctccttttatgccagctgatgtattcagttcagaagatatgcttaacttttttaaggataattaatttgcctagagcaaaaatggagatatgcaggaagtttgatattgcccattacttcacacattttgatttattgaataccactgggataatacaaatttaataattggaacattatttcataaccattttttaaaattaaattttatctcattcagccattcagccagttttttttttttacattttattaataccaaagtgaaaaatggcctgtgcttatactacaaggatctcatatgaatgcagtcctgattgttcgacacagcaagaaaattcactttcacagtcaacaagtcatcttactcagtagaacacaaagtaaatggtttataactccaatatttgcaaggaaaatacagtacaaattactaaaaaatactaaaatatagaattgtgttcaggcatctccactacatcaatcgcagcagtaacctgaaatttgaaacttttaataaaaagttcttaaatataaattatatggcaaatgtacagtacattgctttttttcagtctctttttccagtgttttgcagtagaacagggttcctaccatcacctcccttaggtttaaaaaacccaaaacacaagtctgctgtgagtccttcagcatcatgagtgtgagtgatctgagtctggaataccactgtctctgtagcttcggttactactgctttcactgtgattgtttttgtacagattcattccattaggaggaaatatggtgtgtattacaaactcctccttcgagatgggttcattgcttattggtaacatctgaaaagaagtttccctgatttccaggatagagttgtccttcttagtgccagcttctgcatagtcatcctttcttctcctccctttgctatatgcacagttccttgagaagagcgatccattcctatgaacataccaacacactaaagcaagaagggcaatggtaaccagggccacagccccaccaatgatggcagccaaaggtaaattggggtttttgtaaggttctttctcttgctctcgattgagggtggttgtagggttgtacattcgaaggggtgcagtttcagtctcaatacaaacaggagtttcatcaaataggtagaggttgctggtttccatgggaaccatgcatactttatagggtgaatcaggctccagggctgtgaccaagtactcactgcgttcccctgttacaattgtttctgttatagatccaaatgccgggctatggcccagtttaagccagctgagtctcaaagcagtcataggtagagcaagtttccaagagatatgaatggtatcagaggtgacagacttcacagtaattgtaattgtttttcttgagggactccctgtggtttggtgatccttagtgagcttggggttcttaatatctggctgtttggtcactggagctggccactgtccttgggcaggatacactgtgttgggtattgcagtggttatctgaatggtgcttacaatcccactgtccttacaatcaaacagttctgcattgagatccttaatagccatcccacgaaccttttctggggcttggcacatgagcccacgcacgttgaccttcacaggtagtgattgtaaccagtcacgtacccatttcatcttgcacccgcaataccagggattgttgcgaagaatcagttgtgttatattgtccaaatcatcaaagataccctgaggtaaattacttaggttattattggacatatccagtcgatagagctgccttagataagaaaaagcatttgggggcacccgattgatgtggttatcttgaagataaagcttcctcaggtttgtgcctggaaggtttactggtgcagcagtcagggaattccgcaccagggacagctctgtcaaattaactaggttgaagaaaactttgtcacctaaaccatgattgttcaacaggtttccatctagaaccaggcgttttagactagtgagaccttgaagagatggtgatgaaatagtggatatgcgattatcatccaagcgtagttcttctatagtcctgggcaaaccccagggaattgtgctaaggtgattacgggacaggaaaagcagtcggagatagttgctgtctcggaatgctccctcttctatgctaactgcagagacagagttgtcatctaaatgtaattcttccagatagggaatttttgaaagtgaatcataagtgatagtccttatgttattttcttgcaaatgtaactcttttacatactttgggaggttggtaggaaattcatctaaactgttgtggtataggtatattctttctactttcagcaagtttttcaaatctgaaggaatcccagcattatttatttggttgttctgaaggtagagagttgtagcatcctctggtattcctgttggaatggatgtcagaaagcgatcattacagtaaatgaaacccgcatcgcagcgacacacagatggacaggatttagccataactgatagaggtgctacttgaaggaacagcccaattttagtcccgatgaggaagatgctccaggctgcgctgatcatggtcagcagtgttgaggtctttatacaaggtagcttccgttacttcagaaccctaaaatgaagtgagtaaaaaaagacagaaaacaataaggccagcatactgaatataatgtttaaaaacaaatgtggaaactaaaatatccataatcacttttaatattttcatttgttttgggagggggcataatagggtttattgctagctaacaatagacactgtcatataatctctttaccttaatggtttcttaatttctttataaattaaaaagtatctgtcctaaatccatttgattttgaaatattaaatataattgaagttttattgaataatccaaagtattttaattatactttatatcaacctttagacagtcactgatcaagctaattgaatatccatttcttacttaatattcataataagtaacaccttggaatattatttcttatatttaaaggtaatcattttactgttatcaaaaaaccacacatttttatatttactttttattaggcaaaaactatacaggtgtagaaaaatgtcataaaaatacctattctcttcatactcaggaatagttacacacatcttgagatcctcaatctcaaacccatagtttgctttgattattaatgtcatttcattttctttggttattaattttaagcattattttaaatggatggatttctgcaagaaaataagaatgattccttcatttatttttgggaaagaattacaaagctaatacatccagctaacctaagtggaaaatttcacttcatattaaattctgtctttcttctgttcacattttgttatatgtttcatactgcaggttttaatgactttgtccacatttttcattattttctacctcataacgtgttgtcacagtgcatttatatttctttgaattctaacctagaacataaatcaactttttctatggctggcaaagtatagatttatactgatgtattgtgtaatatagtctcttctgtccttttaagtattaattagcctttgtaattttaggcatgaaaataaaatactttgtttttcctaccttattgaacgatgtgagtaaattttgcgggggtgaatatccaatgcacatatattattttcctggtgagggactgggacttataaacttttgtttagtccttggaaatgttcttcaccgtttattcaagtaatcctatggcgtacacacctccagatcaggcttgctgttgtcaatgaacattccagctgcagttcagcatggtgggcaagctcattaaagtgggggcagaaacaattctgcttcctgttactatgtaggacacatggcttcctatgtattttttttttctttctgatagagtttctgtgtgaaagttccttttgtgtagcttaattcccttagtggaaattgccctctttgaaattcttattggctcttctgtgcaatgtggtcagagatagtaacttcagatcctcatgaagaaagtcattcatgatgctaaggcctgtatagtaataggtttttcaggcagttaccccctacctttattcccatccaggattatccaagtataaactttgtacagtagctacatcctgaggtatgattacctgctgtgaaatagctatttccagcttttgcttcttgctgatttttcagaatgtctggtgcagtcacgttatacaagaacaggtattctcttttaagaagtaaaggaaactaaattcttcatttaaagaaaaggaggcatactaaatttcctttatatttctcttccttaaaatatactgggactgagcatctcctgtgaaagtaaaaggttttaatgaactattaataatgaactttaacatactagagaaatttcctagacatttaatttcaatgtcttaaaataacacatctttcatcatagtggttagtcagaagggataggttgacctctttgtttttagacttctcattttcttatacaaataaagtaggagccaaagttgagattgtcatcaaacagataatttctattatctgattgtgtcactttgaattaaacaccatggctttcaaattcaagccagtctttaaaaatttacttttaaatcatatgcataaaatgataaaatgtttaaaaagaagaaaacaagtacatgtcaaagaggtgagcaaatacattaacaaatatttttgacagaaatgccaaggtaactttttaggcatttctgaacatgatttaacaaagtcacacaatccacaatttagagttgaaaagactattttaaaagcttttcttttgatttgcttagtgccctgtttgattcctcctgcaggtctcaattctcccaactgcagaatgttgacatcatcccctttctctttaggggtgtatctaaggactacttagtgatcttgaaactctaagcactcaggtgttcttgcccaaaaggtgacatagaagttcaagtcatatttagtttttctggagaatactgttctaattttcttttagcatactgagtttgaaaaaaaaattgtatttgaaatagaagggacactattatttcaatctccttgtagtgaccattaggaaagcacatcaaaaccaggtggggcatttctctctaggttcatacatgaatattgccagtttttaataagtgtatttttcatttccaaaagaagacttttggcttgactaaagagatcattgaatttaatgttgactgctttgcccattatcaaatatgcacgaagattttttgagagtttagaggaggtgagtaatattcgaattggttatgcagggtcatccactctgatactttgtatatatgtagggaacatttgagtatcctggaaatatgtgaccctcaaagtaaggactaaagtagtagcaatttgcttctcccacagttgctatctaacatccaacaagtatagcatctgttccataattcagatactctgctgaacgagtatgttaaataaggccacaatttgtgtttctggttctctccaaaaattcagtttcttttagtttgctaactacataccaacatggtcataggctatattaacggaagaaaagtgaaaacaattacagatacatataatttattatttacgcaacttgaaacaaaaatagcagttagcagatggatcaaacagtctctagtgaatattgcaaagtgcccacagaggaaagtttaaatgatttattgtttaatgtgaggttttactgtgatgcctttagggctttgctcattattgtcaaattccaatagtatcttttcttgaaaactgttgctttctcagtgtgtgaaaatggaaaaccaagctgctgaaattataattacaaagttactttttaaagtatcttctgtaaaagttttttaaacttgaaaattattcaacatataaaataatgtggttaatttaagtttagaaaacaattgcttatgttaaattgcattagaaactaattaaaaaccattataaaaataacaagtgagaacctgcttaaaatgttaccaagagtcaagcatttctgatattccagggatgatggtgaggcaatatatacttgagatgatgaatccgctgattggggatttaaaaactgattgtcccctgagtcaggtcagaccacagtgtgtccaaggtgatgatcataatgataaccagacataaaataaatgtcttttatcttgtgtctggactatatatatatttcaccaaataaggctctaacaatatgtattgattttcacatttttaacccagagaatgaaagagttctaaattggtgtgaaaagacggaagattaatttgtttattttacctgttttacatttgtgaagctgctttctctattctgtttgatatgcaaactcacatttgccattcatacaatagtggtaataatgtgggattaacagaaagccttaaatctcattaagttcttggaaaatgtcattctcttctccccacattgtattaaaataaaaggcaaaaacataaaacaggtttcttaggagagaaggatactctttcggaaatgaagattacgttcagagctactctcatatgcccctgctcccttaggctcaaaacagttcatgtttaactacgttttatatcttctctttcccatttatgtttgaaactatagtgctaaacagatttttgggttttggttttggcatattaaaggctgcaaggatctcttcatcaaaaatgaacgatcctctcctatccttagaccttcccctttctgagctggatctacatatttgcgcacctagaaatactgtagtcaaatgtcgatgatgaaaagaaaaatgacccccactggcatggacactgtggccaggtttccataacactgacttcagagcctttctgtccgcctaggcttgaaagaggccattacttctgaacaaaatgaatcgatcttttagaaaaatactgttaatggggtaacttgggaggaaaacataaatgaagccctggtaacttaatggaatgtttaaaaacattttttaatggaatcattatttaactataaaacacttaaaactgtagtaaaaagaagaaaaacataaccacctcactgatgaatcaaatttttaatagggatccttatattcatattcagtttatttttacaaataaaaattgtggggtttttttgcatttataatgtaatcatcaagtctgaaagcttccaatttatttccatgatacacccaataaaacatgtaaatagataaggatactattttagggaaactaatataagaagttgtatctgaatagaaaactagtatttaaataaaatcaagagcttgcggcaatctacatgtttatgtgatttcttccctgctactacaatattttggaggtgggagtgttatgagaaggtatttcttatgttttgagaatattacttagattaagatgaagctgtataatagtagtgctaacttcttatttaatgccttagatttaaattgattttgatttgacctgtttgatcattagtcattttttaaaaatattaattcaagtataaggttttgagattatagtttatttttaatgatttctctcacagaatgatttcttaatgctggggacttttaaaaatattcaatctaaaatctaatggcatgtagaacttttaatccaagttagttgcattgttttaagtaaaaccttgagactaaagaaaacacatgcctaaacaaatgtatccaactttgtgaatatttctaggtaaactggaatttatacaatcataatttagagtattaggaaggtaatttatttatgaaggcttaaattgctgccaaaaaagctcaacctgtgaatgctaagcctttgcaacaacaaacggtatttcaaataaactacatatacggttaaactgaaaaactggagtacatcaggttagttgatagtgacagcaaaatgctttctaagcagcctgtctggtagttaaattttccatgatcatcagatttcaggaaagttccaattcttttgttcaatgccaggcaagcagaaggacctctaactctcctcttgagagtcatgaagtctgaagggtttgctgagaggcagagaagcaagtgtgccttttcatacttggttttatccagactattttctagcctgaacaaggtccttgtttcatttatggaaaatagaggataaaatttccaatgctaagtatttttactttttctttttctgttactggttattttccccggtacgtttctgacaaatgaatcaaattctgcttcatttattttgacttgtaaagttaaatcaagcatccttaaaacaaaaaggcaaactgggatattatccgtcagcatagtgaatgctgcttccttttatgatattaaacccaaagtaaatgaattagagaacaagagttgtaagaacgagtaagatattaatttagagagtggtgaaggtaagtggtgcagagtttggggtgggggcatgctttaaatttgtgcttttgagcaaatgcaattaaaagtttgcctacttttgttaaaccacgttttaccattgcagacttcaaattcctttttaacagtgtgggtacaacttggttgatgtgctttaaatttctaatatttaagtttccatacagtagttcagcaaatacatttattttagtctactgtgtggcaagcactatactggtcggtgagaccacctgaaatcataaaatacattgtttttcatgtccaagcagggtattacttaaaccagatgaagaggaagaaaatcaacaacacataaactgatcaatccacagtccagtggcacactttaaaaatggtttttaaccaaatgtggtctgtgggttttctcttcaaagttgcctcggtaacttgtgcacatgtaaagtgaaagaataaagaacaaaagctgtcattgtctcatcgagtgagagcaatttctccctcctttgatttaaacagaataatacctgcagaaagctttttatacatccctgacacttgattttagggtaggaaagagattatgcatatgcaaaacaaatgaaattttagcttttgcttaaattatattctattgctttctacttaaaatctgttttctctggggttttcgtaaatagataactcaaagttctttcttacacaacataaacatagctttgaaaactgtcttttagtgtgatgtttaaccaaattgagtgatgtcgatctgtattttgaaactggaaaatactttttgaaatgtgtatacctattttcttaagaggaagaatgctgtttcagaagaccaactctttgttggaaatttatttgttgactttcagtaaatttttgaaatggtggaatgttagaaggagctgagaaacatccctttttatgctctgaagagaaaatgcagttttgaggattaatattgctgagagatttttactgtagagtttttgcccactggggggtggtacactctaccagaacactgctttctgaagccgcaagtcagatgttggctgctgctggccagtttttctctggtttaattacaacaaagcctcccgttgagaagaacagtgaaggcctctggggcaaaaggtggggggtgggagggaagggggaaggaggaaagacggaggggagaaattatggcctttgaaaaattactgaatcttatttccattgttgactttatttatggtagtcttcatttgatttaaacagttatttctaatgctttttttttttaaataaatgggtttgaataaaagaatatataaggggatctattcagaatttttaagttagctctggattttgccattaatcaatcacattctttgttatatagcccacccaccttaaaaagaggcatagaagttaagaaatgactgaaatggcaactataaaccaatactttttcattgaccagatttaatattggtatgaacattggcatatcaaaaatgaaaagcaagaaagaagaaacattaatatattattaagacaaggccaattccctgcactgatttttgtagggcttaaaactgttcaaaataatccagaaaaaggaggaagccttagggtgtgtggccaagaaaagcacagaaaaatctctctgcagtgcacttgcatgtttaaagctgattattgtatttttcatctagagagactgagtgttcattagggtcttgtgtccctaggcaggagatgctgagcataattggagtttctatttgattgggcaatatagtctagagaagaaactggggtaaagataattaatagcttgctaacaaagtctgacagccacaagatttcaaccaaatttatttcacactgcttcatttagctctgaaaaagttttgatagaattgtaggctccttaattaacacttgaaagcaaaagaaacataccttctattttgctgccacatttagttatgacagattttcttactgtttttcttctttttgtaaaaactttatttgctatccaattatatatctcacaaacgttatgtttgggaagtgtttaattgtgcattttgaacccagtcataattgattttaaagggtggggtgcagcgaaatgaaaaacccaattagtaactggtagacagttttacagaaccgcaatattaatgaattcattatgtttattcattcactaatattttgctgatccttggacttgatgtgttttggttgtgctcttcaaaaaatcaaattttagttttcttagtaaatctatgcgtttttgtaactctgtttttatttcagggtaataaatagatgtgcgtttgtctgtgtgtatatatatgtgtccaaactaaggggcatatctctgatttaattttcccatggtaaaacctggcatattatcattaatatttgtagtagttggtaatgttgatattattgattgtggcacttttaaaggattaatttttctttactcatttcggaagagatgaatattagtcatctgtcactttgggtcaggtataagtgattctccctgaatataagcaaatttattctttatgtttaggctggtcaggatatttttatgcagtcagagataaatgaaaggcattgctacagctgaaggacttttctagtggctttatttatgttgtttctggataataaaataacatagatgagcattttagacagatttattaatagacagatttattaagaatgtttaaaatagccttattattaaaaccattagagattttggactaaaaattgaaaaaaaaatcaattttttttcttttaaattctaaataaaataataaaaacaaaccccccagatgttgagaagacatggatgggcctgttgcactctttacctatatgcaaccattttgtttcagacctaattcagtgaacaaaattttttgagaagatacatttaactactttttcaagctttgtagtataaatgcatttcttccaatataagattttcctattataagttgcaaagaatggatcctctgcaaaacccacttgataagggctctactcatttatttttctttcctgctaccccaaactcactgcatacatcaggcatagcttccagggtgagctttgttagtttttctgagtagacttagccatttactatgctagtcacatacttcacttgcctaagcaatggattttggtgttctattgaagagggaatatggtttggaagagtgtctccccctcctctgagttcaatttactagttgagatttgcaagcctgaaatgcttgaagcagctcaggcacgatagcagtgcaagctttaaaatctaggtgtagctgttaatcctttacagaggcacataagtctccaggagtagctcggctagctgtgagcaagatgtatgcttttcatgtactgcgtactcatgggctgagggattattgattttctttcacagttgtaaaaacagcaattggtgatcatcccacacgtacagtacacaccaagttgctttcctatctgtgaagaatctccttgtattctttaatatttaacattgaactttccaacttgctgttttccataaggctcttttcacatagcaattactcaagacagaaaatagccacttactatcttttataaatgaaagaaggttctaagaaacttcttacattcagccatgatagtgaaatttttcattgctggcttgcacgcacatatattgcttgttgtggtgacagagcaaacgttcctatttggatttctcatagtatcaagtcgtttctttctagagagtaaaaccaagcaaactttctgggacaatcataagaaaaaacatggaaaacacttaccaggaagacgagaaaaagcaatcctatatacactgccgctatagctgtaattccattgacagtgaattggagtaatagccctcccccgtctcccaagctctgcgtccagtccacacaaagcccacggcagctgcaggctgagcttgtcctgcttcagatcactcctacactgaggagtgagcgagggagagcattccagtttactgcacacagcccacctccaagtctgaagtttaaagcttcacctcgcagtggctgaagaagggggtgatgtcatagatgggcaggacttagccaagatcttgttcagtgaggtaactggataatcagacagatgagctttgcaaacgctagagggggcgagagcagccaaaatgaagcatcagcctgccaaagctaggatgccatttggtttgtaggcagccctttggaatctcaacattttctaaagtttactacaaggcagtggtagcatacttatgtattttttttaaaaagcatgttagaaagatatttttaagatcacaatagaaaaagacaggctttgtcttatttttaaaccatctgtattgaaaagaagttaaccaaaatcaaattagttttattattcactagctaaaataatgttataattgtggaagatgtatgccagtaatcccaactgtgaatgtttattcaacatatgaataaacagcagattcaaatatatacatcagggctgggtgtggtggctcacgcctctaattccggcactttgggaggccgaggtgggaggatcacctgaggtcaggagttcgagaccagcctgaccaacatgtagaaaaaattagctgggcgcccgtaatcccagctgtttgggaggctgaggcaggagaatcacttgaacccgggaggcagaggttgcagtgagccaagattgcaccattgcactccagcctgggcaacaagaacgaaactccatctccaatatatgtatatatatacacgtgtcactgattcatttagttatgggaagggcaataggaatgccaaaagatttttttaaatggtattaaatggtctgttcttttggaggcgaagaagttactgttctctatgttttagaaaatgaaagtatgttttatgtacttctgctacgtgtttatattatttaaaatggattatttatatttaacgatcccccaataaaatgtttttaaaaaatttaatagaatattttcctttctaaatgtttttgctgatctgagcatgggtttagatataaacatcttaagaaaaaaatctttcagggtggtttgcctggattgaaattattttagtttaatttaggtacatgaataaacactggacaattgtaagacgtggagattataaatttctatgcctaattaacagaattatacttgtatttttaattatgatttttgtagactggtttctgctatttggtcaacaattgctttgtgcccgtaagttttccatcaaataagtgtatttcacttgttcatgttggtggtaagaacttagcttttatatttacctggaggaccgttgtcttaaactaatatctttatttgctctattcttagaggtgcatgaccttctcctttgtcctttctcaatttttccctgcatgtttatttctgaagaaggccagctaatagtctttcccaggactatttgattgtggtctcttcattagcttcatttagtttatctatttatatatttgtttgataacagtttgacctgagttcccttccaagaatgggtgatatcaaagtaggtgaacccttgataagaaatgtattgaccctattgttctatgattgcacttttgtgggcctcagaggacagacccattaaatctaggagttttagattctaatgtccattgaaaagccaatttctttgaactgctaggtagtacaattaaactgatatgcagcagctgaattttgggaggaaagggaggtggatatttttctgttactatgaaacaaagacatggattaaattattttattaaataattatttctagaagccattttcagataggagttggttctgtttaaaaaagaaaatttttgcctggtcaaattcctgtgggtttatagccatatttaatcagtttcgtcttcattcaggcaggccttaaacagaaaagaaaaatcaattggtgaattgggttataggtatcaaaaataaattgtactggcctgggagttagcagtttggaggtttcccttctctgggctgccattgttatatgacttcatatttgttgccctaggctttggtttcatcacttgacaaataaaggcagcaaggatttattaaatgccaattattttttgttgctttttttccccttttaagctatggattaaaatatgggaaaagaaaagaaattgtgaaaatatattctatactggggtactgactttgggggcaaactcttagtagaatctgtggcctcctattctgtccaaaaatatatactcttttgctgcatacatagtttttcacttcccgctcttatcagctacctgaaatgctactagttgaaggtgaatttataataatgtgtgccccctttgaaatagtatgtacaatctctggaaacatgaggttatcatgagttacttcagattgccctcctcttttgttttctaaggcactttggctacaataaggggatgactgttttgattgaaggggatggaatgctggcaatctttagcatgaaacccttttggctgtaataggaagggaggaggtggattctcatatcaggaaggacttggctcagggtagaggacaaccagtgtagtagacctgggtagtttaagaacatgggcttcagagattagcacagctgggctccatgttggctttgccacatgactgtagacaaattacttaatctctttgagtttgttagctcagtgcctgactcatagtaagtgctcaataagacgatagctgtcattatttaagatgggggacatccaagcacctggaacaaaaaggacactaagaatgggagaagaatacacaaagggaggtagtacagggccaataacagatttttggaatttttcaaatttctctttgaagtaattttacagtcagtaaatggaagtggaaaagaggaatagaagagcatttcattgattttttttttctcttgtacttacacatctcatgacctcatgttcccagaacttaacacttagttgggttctagtagatattttgggttgaaaagatgtttgctgttttgcattttgttctgttttgttggctagcctgtgaatctagcattgtacgtgagaaagtgcatttcagattgaaagcaactggtttggaaatgaacttcaataacatatcccagttttaaaactctaggactatctaaacttgtcatctcaaaggactttgtggtgttctttgtttgtttttatgagaaaatgtgagatgttcactagtggacatgaaagtagattggatttggaattgggtttcccaggttctgccatttacttgtatatccagacaaaaaaatgaaaaacaacatacacacagaagcctcaaatctgtcttttagttaccaactaccagctgaaactgactaaaacacacagtcatttcatggaacaatacaattcaggtctgtctagagttaagctacctcattcacacattcattcattcagtcttcacattcatttattcattcatcatatacatatttattgactccctgtgtaaaagaaactagtaggactagatgatccccaaactatctccaactatgaagttctgagatttaatcttagaagacattaaggttcttttaagcctaagaaacattcttcatgattttcctttccctcagcattcttcatgagaataaaatcttcaaaattgtgtaaagaaaacagtttggatgggcgcagtggctcatgcctgtaatcccagcactttgggaggccgaggcgggaggatcacctgaagtcaggagtttgagaccagcctggttaacgtggtgaaaccccgtttctagtaaaaatacaaaaagttagccgggcgtggtggcacgtgcctgtaatcccagctacttgggaggctgaggcaagagaaccacttgaacccaggaggtggaggttgcagtgagctgagattgtaccatgcactccagcttgggcagtacaagcgaaactccatctcaaaaagaaaagaaaagaaaaaatagttcatacttttgatagattaaatgtcttggactgttattagttaagatacttttggttgcaagtcattgaagatctaagccttacctgcaaaatcaacaatgggaatccattggttcatgtaactgagaagttaaaatgtatagtacaacttcaggtaaagcttgatacatggcttaaaatatgtcaataagaatacagtttctctctggctctctgtcctgcctttctcattgttggcagcctcctcaggctatatacagtggacctttggcagctctgggatttcctcttaggcaataacagttccacatatcacattcccataacacaatgttcaagggagagaagcgtcctccaaaagcccctgcacggagccctgggggggtcactgtttctcatttgcttaaacttgatcacaggttcattcccgaacctattacatgggtggggagataacgctggtgagcttaagcccaatgcaggagctgcagataagcccagccttactcagacacagaactgagaatggaggacagggcatgatccaaaggaaaatggggtactcttaggttgagaaggaaggagtggatgctaaggatcagctcattttcagaggttttaccatgctgaaacttgggcatattttatacatgtataaacttgaaactgctctttttctctttgtcttttttttcttaagccagagtttctgttaaaattgccaaaacatctttaaaagatactcttatttgtagacgctctcaagtctagcccagatttttctgtcaacaggtagtgatgcatgtcagggcacatcagtattacatcttagcataagcctataggatgttaataaaatatatagagagtgcactatctgtaattctgtgaagtcaggccagatgcttaatgtagtagttagaaactataccacatctttctcaacaattccaaagggtattggagaaataattagattttagcaggtcacggatgccttagaatgccgaaaggttttgaaaatgctacgttaaactgttcttttgttctgatatttgccttttattagtcaacacttaaaatgtacctaaaaacaatcacataacccttttaactatattcccaaaacattctgcactggaatgagatctgtcattacaggacttgaaacagatatcaaagcaaaatcagagtggttatttccctgcctgcctgcctgcttgcccaccctctggtacacccttcttttccccaacactcatgttggactgttacactttggggactgggagaaatgcaattaaaaatcacaactgagaaaaagcacctccttggcctcccaggaaagaaaggaggaattgtggttcagaataagctagtaaaagtcacggggtgtggcagtagctggtgcaaaactagaagcctgctgatccctactttcttccctcttcagcacctccatatatggccatgcagatacagcatatagaactccagctgatataggtcaaagctgtgtccttgaccccttgccactccccagtgccctgtccccttcacttgttttaaaatgttaaaaaaaaaaaagacttaaaatgatccttgaaaaaaatgagagacttggaggaagcagattgagtcaatcatttctatatgatactttctatgtggccctgagaaaataactggagctctttgagccttagttcctttatttatgaagacaggtatgtggcacccacctaatttcctattatggacttcaaataaagtggtggatgtaatagttcactactaaatccgagaaagcacataccaagactgagttgaaacctggggatagttgcttttaatcttcatagtgatgagtggggccaggatcagttcaaaagaaacaattcactaatgtcaaattgaactgtgtgctttaacaatttatctttgggaatgaaacaatttgagaaatgcttctgccttctctcctggatgctagactttgagataacagtatctaaccctggttctgagacttaattacaaatcaaaggacaaattccttatctttggcaatgattagtataaaatacagctttggaggaatgactaacagttaataggagcagatcaatatgtgtctgattattgacatgtggatcaacaagatattatacaagtggattgccctgaagcacgtgattttctctgtgtagccagctactgctgtcagtttggaccaaagtggtcgtcattttgaaaccatcttattgtttcactatttctggagtattggtgctaattttagacacacaaatagactttctgaaaggaagattttctgaaattgtcagatttttttttctggaaactggctctgtagttctccttgtattggagattatctctttgctatttctctgcagtctagactacttgggtacattaacatgcttaatgttgaaagaaacatgtttaaggtagagtcaaagactgttttctattttatcagtttattaatgactatggaaattgcccttcattggcactgtctgcaggaagcagatttactacaattagcatttattgccccttgggaactgatatgaactgattatttgccagattttcggggatcaagtatcagttgattagatttggattatgtaaatgttttacaatctattccaaataaaataagttaaaaattaagtcacatttaccattgggaaattttctgtaaaatataaaggtacttaaattttctaagcatgatttatgataaatatgttatatattaactagactcacttagttcattctgtaaatgattaacctcaaatttgaggaatttgaaaacattttataattttttcactagttttgtttgttttttgttttgtttgacatttgaagtgtattcatgctggaaattcacaaatactttgctaggtttcctatgtggatttaaaaattaagatctagactgaacaagtttatttaaagtacacaaatattgccaaaatgtatttatagtttaatgagctttcattcttatgttcaaagttgttttaaaaattgaaggtagacttgaaaaagaataaaaaagtgtgtcactttttaaagttattaatttttgtttggagaaattcaaggagctttttggttgtttaattctcatgtgtacatagaagcaacacacaactgtttgagcagctttggatgtaacccctctttgttttcttcagtagcccagggaacagacttgtcactcttaagtgctcacgtgtaatcctgtcctccctttcttccccaaggcaaatcagaaataagcttatcagatcatatcttattaacaaagaacaaaggattttgactgaccaaagagtaggaaaggactagcaaaatataaatgttaaatgtttgctgccaaaaatcctagtttgacagtggttttaggtaactaaactttttttgaaagtaggatttacatatttttaaaacatttgcctgaattatactttgtctaggattttaagtgcattagttaatggctttacctatattttatatatgaattaagtacaattgtcactcattattattgtcattgttattattatttgttccttacaagcaaatctttctagcttatatctgagagaagttagagacaattatattatatcctatgtgttttcagtataaagtgttttaacagaaagtataaatagccttctaataaagggagaagtgtttttctgatagaaagtacaatacattatttaggtaattataaggaacttttaaatcatatttgtgtcttgttttcttggttatttttatttgaaggtttttttttttcttagatggagtcttactctatcgcctaggctggagtagctgggactacaggaacgcaccaccatgcctggctaatttttgtatttttagtagagatgggttttgccatattggccaggctggtctcgaactcctgacgtcaggtgatctgccagcgttggcctcccaaagtgctgggattataggtgagagtcaccacacttggcctgaagatgatttttctataaggacaacaagttgttcattatttagagttgtgatagtaggaaggaaataactttagaaaggaagacagcaggctgggcaaggtggctcacacctgttatcccagcactttgatcacgaggtcaagagatcgagaccatcctggctaatatggtgaaaataaaaatataaaaaatactactaaaaatacaaaaaagttagctgggcgtggtggtgggcacctgtagtcccagctacttgggaggctgaggcaggagaatggcgtgaacctgggaggcagagcttgcagtgagccgagattgcaccactgcactccagcctgggtgacagagtgagattctgcctcaaaaaaaaaaaaaaaaaaaaaaaaaaaaaaagtaagagagcaattcccttgtgaaaatcaggcttgcattttcttgaagtttgaagtttaaagtaacctaactttatcacaaaaacaataatgatcccaaatatatttgggaagaaagataaatttttaatccatatgaatagcaaaaacataaacactacaagacgtatgaatgtagtgtttctattttgtttgctgtatgttctgtagacttcctgtgtggctcacattctatcaattgtttttttaaactttcttttcccttggcttctttgctcctacattatctgattctgcttaaggaagagcccctgaacaaagaacagatattaccatctccattctaatatagctgatttctagtaattgtatagcagatgctcgttcaagcacctatttatgtgtattctaacaaaaacatggtattcaggctcagagaggttacagttttttaaaacactttatccaacttactagcattctctttgttttgtttagattgattttactatcatctaagtctcagaatttgctaattaggaggaatgggtggtgatgtctaagtaatctgttgctttgagagtgtttagtagaaactcagacggaacaaaaggagtaagaaggagaaggtagaacaggtactctaagaggacccctagtttaatgccttgtttgccacgtgtcttcccttggtcagtttttcaacaaatgcttattgaatagcaaggtgtgcctcataagtctgatctcttttactatattctctgtttttcaaagactttataactaactttcccaagttggtctgtccacttatacatagattataggttggacaaaaccatctcatgacatagatatataggttcttgagcaatctcaaagaaatgacaaagaaactttttcgtggtctgtgggtgagaaggtcagcaacaatttaaccaatgtgctctagatcacaaaacgtatttgaaatgagactgaaagcagctagaggaaaagtttttgaagagatagtaaggagagaatcagaggtgctaagatagcaacagcatgttaatttgaggtgaaaagtgtcctaattagtaggtagattttggactctttatcagttactatggtggtaagtgcaagcaaggaagacagaggaaattctctaggaacattcataatgcacatatgagaggtcacccatccttgtagtgcgttttggggatggatagaggaatttgctgaattatagaggccaattatgaaaaagaaagtacgtagatttgggctaaataataatatcgatgtaatgagactagtattctaataatgataatagcatgaaaagagtagtggacagctaaatatagacgaaaatatagtaaaatctgattgtacaggatggtaagggtacacaaatatggagatgtgttactagtctggaatgtgacctaatcctgctgatttccatcttttgctcttccagggaagagagatgaggctttccaaaagctgccacttttaagtttacaggagaatccatgggattcccaagtttttatctgttctgtattcagaaatgcaattccttggctaagaaagggtcccctctaccatttgctttagaagaatgaaaactgacccttgccaagagagccagaactaagccttggctattaaaacgaagatatgggacatggggccaacatgtcccagccagatcacccacacatccattaggaatatggggcagctttcaggggtttctggtgtgtatccaggttaacatctagcctaacattgccatgtcagtggaggcaacagagtcatccaagatatgaaaccagaacaaatgtataggtataagccaggcacggtggcttacacctgtaatcccagcattttgggaggctgaggcaggtggatcatctgaggtcaggagtttgagaccagcctggccagcatgttgaaaccctgtccctatctctactaaaaatacaaaaacattagccggtgtggtggtacgcacctgtagtcccagctacttgggaggctgaggcaggagaattgcttgagcccaggaggtggaggttgcagtgagctgagattgtgccattgcactccaacctaggcgtcagagcaagactccgtctcaaaaaaaaaaaaataaataaaataaagaaagaaagaaagaaaagaaaagatgtatcggtattagaacatggaataaaaattctgtgacattaagggttcatggtaatttgtatcagaatgtacatgaaagaaaatatcaagaaggaaggtataccagttcaggatgtgttatctactaaatagtgtgccagaatcctaataggcatttctatttacatttggctcctctgaaccttattacttccttcaacttgtcttttatgaacaacatcttttattagtagacaaaaaaaaaaaagaatttcttatcagtttaggaaaaccaccaattgtcctgttatctcaaggaatgatttttggtggaatgtaccctaattctattttttctcctcagtatctttaatatgtgatgcttacagattcattaaaaaataaatgaatatttatgacttggaattttatgctatcaggaaccatatatgcattttttaactgtaagaaatgaactgaccactactgtctatttccatcagacttgtttcaattaacagcactttgggaggctgaggcaggcagatcacttgagcctaggagttcaagactagcttgggcaacatgatgaagtcccatctctacaaaaaatacaagaattagctgggcatggtggtacatgcctatggttccagctacttgggaggctgaggtgggaggattgcttgagcttaggaggtggaggttacagtgggccatgatcaccccactgtattcctgcctgggtaacagaatgaggccctgtctctaaataaataaacaaacaaataaataaatggaaaataaaaataatctgaattcccactatccagtattaacattgggtggtttaaagcctttcaaatatttacaacttgtacctatatacaaacttttttttttttttttttacaaattaggaaaatagtgtacttgttttataacttatttgttttttatttttaatttttgtgggtacatactaggtatatatatttatgaggtacatgagatactttaatacaagaatgcaatgtataataatcacatcatggaaaacagggtacccatcccttcaagcatttgtcctttgtgttgtacttcagttaatactcttttagttattttaaaatggctatagtcaccctgttatgctatcaaatatgaggtattattcattcttcttttatatatataatagtacctattaaccatatatattgtatctatatggttaattaattatatattatatattaacattatatatatatatattgtacctattaaccatccccacccacctccccactgcctcctgagtacttttcccagaccctggtaaccattcttttattctctgtctacatgaattccatcgttttgattttgaaattccacaaataagtgagaacatgtgatgttcgtctttctgtgcctggcttatttcatgtaatataatgaccttcagttccatccatgttattgcaaatgacagaatcttattctttttttcttttttttttttttttgcccaggctggagtgcaatgcgattctcctgcctcagcctcccaagtagctggaactacaggcatgcaccaccacgcccggctaattttttgtattttagtagagacggggtttcaccatgttggtcaggctggtctcaaactcctgacctcaggcgatccacccacctcagcctcccaaagtgctgggattacaggcgtgagccactgtgcctggccatcttattcttttttattttgtttggctgcatagtactccattgtgtataagtaccatatttactttatccatttatctgctgatgaactcttaggttgcttccaaatcttggttgttgtgagcagttctggaacaaacatgagcgtgcaaatatttcttcagtatactgatttcctttcttttgggtatataaccagcagtgggattgctgggtcatatgagagctctatttttagttttttgaggaacctcaaaactgttctccgtagtggttgtactaatttatgttcccaccaacagtgtatgatggttccctttttctccacaccctcgccagcatttattattgcctgtcttttggataaaagacaggcaataacaaatggggtgagttgatattttaactggggtgagatgatatctctttgtagttttgctttgcatttccctgatgattagtggtgtcaatcactttttcctatgcctgtttgctatttgtgtgtcttcttttgagaaatgtctattcaactattttgtccattttttgattggattaatattttttttcctatagagttcttgagctccttgtatattctggttattaatcccttgtcagatgggtagtttacagatattttctccttttctgtgggttgtctcttcactttgttgattgtttcctttgctgtgcagaaactttttaacttgatgtgatcccatttgcccatttttgctttggttgcctgtgcttgtggggtattactcaagaaatctttgcccagacctatgtcctgaagagtttcccttatgagtttcctcatagcttgaggtctcagatttcaatcttcaatccatttcgatttgatttttgtgtaaggtgagagatagggatcaagtttaattcttttgcatatggatattcagttttcccaggacaaattattgaagagactgtcttttccccaaggtgtgttcttggcacctttgtcaaaaatgagttcactgtaggtgtgtggatttctttctgggttctctattctgttccattgagctatgtgtctgtttttatgccagtaccatgctgttttggttgttatagccctgtagtacaatctgacgtcaggtaatgtggttccttcaactacttttctttttgttcagggtggctttggctattctggtttttttgttgttgttgttccacataattttttttaaatttctgtgaagattgtcattggtgttttgatagagattgcattgaatctgtagattgctctgggtggtatggatattttaataatattgattatttcactccatgaacatggaatatctttccatttttgtgtgttgtcttcaatttcttgcatcagtgttttatatttttaattgtacagatctttcacttatttggttaattcctaggtatttaattttatttgtggctattgtaaatgggatttcttttttaatgttcttttcaggttgttcattgttggcatatagaaatgctactgatttttgcatgttgattttgtgtcctgcaactttactgaatttatcagttctaatagtttttggtggagtgtttatgtttttccaaacataagatcatatcatctgcaaataaggaaactttgtcttcttcctttccaatttggatgccctttatttctttctcttgtcttactgctctagctaggactttcagttctatgttgaataacagtggtgagagtgggcatccttgtcatgttacagatctaaaaggaaaggctttcctcactcagtatgatgctagctgtgggtctgtcatatatggctgttatgttgaggttcatttgttctatatccagttatttgagggtgtttatcatgaaaggatgtataactttatcgaatgctttttcagcagcaattgaaatgatcagatactttttgtcttttgttctgtagatatgatatatcacactaattgatttgcatatgttgaaccatccttacatcccagggataaaccccactttgtcataatgaatgatcttttcaataagttgtttaatgcaatttgctagtattttggtgaggttttgcatcaatattcttcagagatattggcctgtagtttttgttttgtttttggtgtgtctaacttatttgttttatgactttgcacagggacctgcataactagcctctctagctgggcgtttgtgtgctttccagtttttcaagattgtgagcaagttttgataaaaatactcgtctcgcttcggcagcacatagacttaaattggaacgatatagagaagattagaatggcccctgcacaaggatgacaagcaaatttgtgaagcattccatatttaaaaaagaaaaaaatactcctaactaaatctttatgcttattatgtatatttattaggataacttctttgaggtaaaactgatggtttatagggatgacactcttttaatgaatttgctgtaattacaagattgccctccagaaaggatatatgcacccttctaacctctgccccttcagtaacattgagtagtgttcatctttaacttaataggagatacattgtatgttaatattgatttaatttgtatttatagaaggagcacattttcttgttttgggaaaggatgttttctttttcttctttttctcgttccttaatttcccctttttggctaaactttttctatgtgatccatttttttttttagtagataaacatggaagtacagagactaatagaacaacaatgcaccacccagaattaacaaaggttaacatttgaatatttttgctttagcttcttcattaaaaatgggatataatatgataataaagttgaaatattatgagtttccactctcatccactcacctctttccttatccataggcatctactatcatcaatttgatggtattttccagtttatgtttttcatatttgtttaattaaaattagcgttagctgtgactcttcaaaaattcaaattatgagtggcttaaacaatatggatgttgatttgtcacttgtgtaaaagtccaaatagggggtctagggtgtgtatggtcctccacatagtcagcgacccatgtttcttccaacttgttgctttatagtgggttaccttggtctcataatagtagcagccttattccaggaagaacagaaaagggattataaatatactagaattaataattactcatctgttataattaatagcaataattacttattttaatgataatttattcattaactgcaaaactgtatttagttgtctcctgtgcaaataagactgcaaggaacattcttttccatatctcctactccacatgtgtgagtttctcttggtgaatatacctagaagtggaattttagggttttaagggatgactattttttacctatactagatattgcaaaatttttaagctttctctgttagagtatttttaaccacaggtaacagacaatggaatttaaagtggcttaaataaagaaagctatcaatcacctcatataataagaagtccagaggtagaactgctctagatttgggtaattcattgactcaatagctttcctcttggtcatgaagaatcaggcgcagacaaaaccatggccagaggcgtttattcctctatgtctcttttgaagggcaaagaaactttctttagaaatttgtgttagctacattctttcatgtttcattggttaaaattaaatcacatgccaatgcctaaattgattacttgtaagggtctacaagaccatgatgattggctggggggcaaggctaattttgcttaaaaaatatcatcaggaggaaggagatacctgaaaaaaatatacctttaggaaggaagaaggggaaggtgggtgtcaagtcggcaatctgcagtgtctgctctgtctctaaagtggttactgcattcccatcattagtatttgagttattaattgtcaggatttttgtttgttttaccaatctaatgatcaacactttgttgttgtattccttagaattttctgtttctattgggttgtacacctttttagatatttatagacccttaggcttttcttttctttgaagtaccttagctatgttctttgcctgatattctcctaagttatttgtacttttcttattgatttgtagcagttctttacatattcaggataataattacttgtatgtatacttgtgttggaagtttcttccatcagtgaatggcttgtgtttttacatttgtttgcattaaaaatgtttttataacttaaatatttgtttcttgtgtcttattcgaagaaccattttttataccaaagtcatacaggttttttttctatttcttattgaattttaggtggatatcagcctttgcttgctatatcctagcagtttttaaagtgatggatggactctttcaaagtgtctgcaagactaaaattatttttataatgatattaagatgtcatttgccctttcccccatatatgtagaattgggtctttttcaacttttattttagattcacgggtacctgtgcaggtttgttacatggatatattgaatgatgctgaggttcggggtacaaatgatcttatcacataggccctgagcacggtacccaacagttagtttttcaacccttgttcccctctctcccttccttctctagtagttcccagtttctgtgtattcccaggtattttattttgttcatggctattggctttatgcctatgagtatccagtgtttagctcccacttctaggtgagaacatgcagtatttggttttctgttcctgcattaattcacttaggataatgacctctggctgcatctgtgttgctgcaaagatatgatttcattctttcttatggctgtgtaatattccatggtgtatatgtaccacattctctttatccaatccactagtgatgggcacctaggttgattccatgtctttctattgtgaacagtgttgcagaatagaaactggtagaatgatttgttttcttatagatatatacccagcaatgggattgcagggtagttctaagttctttgagaaacctccaaactgctttccacagtggctcaactaatttacattcccaacagtgcatatacaggtcattaacaaaattaacataaaagataccacttgtaacctatcaaattataaaataatgtcttaaatgataactaatataagacagagtgagttatgactctgactaggagtgtaaagtgataactttctggaaatatgttgcaaagaccccactaatccatatatttttaactcagtaatttctgttctagaagctagcctgaggaaactgtaagaaagacgttcagtgtagaattatttaaaagataaaaaagtggaagcaaccacatatccatcaataaaatacagaatcaagttttatctatggagagaattattttgtaaccatttatgtggtttttttgtgatgacatggaaatatattatgtaattgtgagaaaatcagcatataaaactctacatgtcttatgattttaatgatattaagagcaaatttgaaatggaaaaaaggaaagaaactatcaaaatgtttacagtggttatctctgagtattgttatgcatattttaaaaattagctttccaactttttatgataatatatattgttttcactaatacaagtgttattaaaaaggtctggtagagattggctatttttcatttcagccttgagattattgggagtggagagggcccttttatgaaatgaagtctcttatttctttggggagggagtagaacatttggtagtgtgtctttcccgatagaaagagaggaatgtgacccagcagggcctggggcagcagatactaactcagctggatttcaagaacaaccattggatcctgatttagtggaatgcactccagactgcttagtgtcatggttaagggtgctagttttgtagccagagtttctagtttatagcctagttctgccacttgtgagctgaattaagttttgggtaaattacttaatctctgtgtgtgtgtttcagtgtttccatatatgaattgggaataataacactctctgtgccatggagtttttaagagaataaactgaattattgtgtttaaaattgtcagcagagtattcccacataataacctcttactatttttttagtaagttttaataggtcttactattagtggtttaatcagctatctattacctcataacaaacctccccaaaattggtgccctaaaataacatgaaataacttatttagtccataaatctcaatagttatagctcatctctgctccacagggcatcaactgagatggctcacctgggggctggaggatctactttctttttttttttttttttttttttcgagatggagtcttgctctgtcacccagggtggagggcagtggtgcaattttggctcactgcaacctccgcctcctgggttcaagcagttctcctgcctcaacctcccaagtagctgggattacaagcatgagccaccatgcctggctagtttttatatttttagtagagatgaggtttcaccatgttggacaggctggtctcaaactcctgacttcaggcgatctgcccaccttggcctcccaaagtgctgggattacaggcgtgagccaccgtgcctggcctggaggatctactttcaagagacctcacgcacggctggcatattggcgctggcttctgctaggagcccagccagagctgtgtgatgggggtctctattttctccaagtgggcttcttcaggactgtccaggcttccctatggcagcatgtctggatttggaaagtgagcatcttgaacaaaacaggcagaagtgcatcacatttttataacctgtcctcagtagtgacttctttatcctactacttcatggagtactacttccatcatagtcatgaatccatccagatttaagagggaggaacgtagacacttccctgtctatgtgaggagtgttgggcacattgtaagaagagtatgagtggtggaaaatattgtttcagccatgtttgagaaatacagctggccatggcagtctactgaccttttagataacataatatgcttggctttcttatccactaacagcagcaatctcaattctgtgtattagaaccatcttaggactttttactaaatgcagattatgagtgacttttcatttcttttgaatattttctgtatttttcaatgttgaaaacttattactataatgaaaagttttaaatgaaaagataaactttttttgcaatgtatctagatattctacaatctatgaatgtaagatttctatgtagaattttaaaaatctattacactccttctttcttggtttggtcatatttctagtagcactgacctctagaatgaaagaaaagaaagaaaaaaaagattctactcacaaatatttctatgttaaatgtagtggttcctcagggcaaaccttagacaccaaatacagcctataaaactatgaagtgtgatttccactggcttctccttagaactctgggttgcaaacaactgatgagcagctgctggcttttactgctagtgaacttgaacagagagcagtttctattcatctgtcaagaaggacaggcacacaataaatttttgactacatttgatgatacaattcatgcaaataaacttgcaaataagacagtgctctcaagatttcaagaaatggccaaggaggctgttttgcccctcctccccaaaaaactttggagctgccactgatctcacacaaagtcatctctttgaattaaacatgtcttattctgaaagatgccaaggcctggtccattgaaacattcaacttgtctttgcagctgtaatttatttcttctctttcttcccatcaaatgggaaaattgttcattttaaaaagcaaagaccatttaaggtttgaggcaaaaagagaatgaaatatggaagtcaagggtcagtttcaaaaaggaatagtactgtataacaatttagtttacttctaagtggcaactgttgttacatatatataggataaagtatgcaggagtaaatagtggattgaatgtcactgtggtgacccaaaggagtcaatgcaacctctcaagtagattaacttattcttggggacagtttataaaatggcagatttggggctcaatataatttttattcattgaacatatatatattccagtttctatcctaaatacttatattaactcatgaaattctcttaacacccctaggaggtagttagtaccattgtcctgcttttttattttttatttttattttttgagatggagtctcactctgttgccaggctggagtgcagtggtgcaatctcggctcacggcaacctctgcctccctggttcaagtgattctcctgcctcagcctccctagtagctgggactacaggtgcccaccaccacgtctggctaattttttgtatttttggtagagacagggttttaccatgttggccaggatggtctcgatttcttgacctcgtgatccacccgcctcgacctcccaaagtgctgggattacaggcgtgagccactgcgcttgtccaccattgtcctgcttttacagaacaaagtggttaagaaacttgcccaaggtcacacagagttgcactcaggtttcaaaccctggctgacctcttttcacctattgtgctttattgcttcacagataagtttttgaaaaaattgtagtgaggccaggcatggtggctcatgcctgtaatctcagcactttaagaagctgaggagggaggatcgcttgagcccaggagttcaagaccagcttgggcaacataatgggacctcatctctacaaaaaatttaaaaaattagccaggcatagtggtgcctgcctgtagtcccagctacttggcaggttggggtgagaggatcacttgaacccaagaggtagaggttacagtgagccaagatcgcaccactgcaatacagcctgggcgacagagcaagactctgtctcaaaaacaaacaaacaaacaaacaaaaaacacctagattgagagatcatgaataattatctgtaggggatttttttcagagttcacatgcaaaaattaagggtggttattaccaaaaagacaaaagataacaattgttgatgaggatgtggagcaaagagaactcatgcacatttttggtgggaatgtaaactagtacagccattatggaaaacagtatggagattcctcaaaatattaaaaatagaactaccatatgattcatcaatcccaatactaggtatatatccaaaagaaatgaaatcagtatgtcaaaaggatatgtgcactcccatagtcattgttcataatagccaagatatggaatcaacctaagtattcatcaatggataaatggatagcaaaggctgggcatagtggctcacagctgtaatcccaatactttgggaggtcaaggggcaggattgcttgagttcaggagtttgagaccagcctgagcaacatggtaaaacccgtctctacaaacattagcctgacatggtggcacacacctatagtctcagctattcagggtgctgaggtgggaggatcacttgagcctgggaggttgacgctgcagtgaactgagattgcacgactgcactccagcctgggtgacagagtgagaccctgtctcaaacaaagaagggtaaagaaaatgtggaatatatacacaatagaatactattcagctttgaaaaaaaaatgaacatactgtcatttgcaacagcatggattaacgtggagaacgttatcttaaatgaaacaagccagacacaaaaagacaaataccacattatcttacttatatgtgaaatcttaaaaagttgaattcataaaggcagaaagtagaattgtggttaccggtggcttgctgggcacagggtggtggggggtggggctgggggctaggttggttcaaggggtccaaaatttcagttaggcgtgaggaataagttcaagagatctattgtactgtgtggtgactatagctaaataaaaatctatcgtatacttgaaaatcgctaggagaatagattttaattattctacccacaatcagcgtgtgaggtaatacatgtgttaattagctcaatttagccattccacaatgtatacatattttaaagaataatgttgtacatgataaatatatacaatttgtatttaaaaaacaagtaatgtttttttaaaggcaagaaatgtctcagaaagggaaggtaggcagcaaattgatacatttcaggttcattgttcaactttctttgcatctggaagttgagtccaatgggtttggaatgtgggagatgtctgacctgcactgctgtttgtaaaaagaacttgaatgagtcacttcatctctcctgaggatattaacagctgccctgacagccttgctaggttgttggagagagcaaatgaattatcatggttatcaaatcctgttgcaagctataaagacctcattactgttagttattgctgtaatcaggcatcttttcttttagaaaagcatttcaggaatgcctccttttagaagatcacattctgcagtttgttcctctatttttcactacattttatttaatgatacaggtgtgtcaaatgtttagcatggtgcctgccatatgatcacactgaatagattttattaattattacttaatttctagcagaagtcttggatttgcagaagcaattaagggaagatatctcacagaaggacagaagctgccgagtcaagatctgaaaagcagggcttcctagcttttccttgatgtcaaagaccataataatactgaagagagtttggaagtcgaattgctgttttcattctaattttagttttcggtgataatccctttcatttatactatctacttatgtacttatgtgccaaggccattgaaagtggctctttgaggactgtgttaaatgttctgggggcacatctaggtttgatgagaaggaatgtcatgatcactgcctccaggaggtagtatttgccatccctagcctattctagaaagtttataaaatatttttgcttccatttttaaatcataccctcactaccaccctctatatttgccaggggttagtttaccactgtgacgtgaggaaactgacattgtgactcctctttacctctgcatttttctcactagaccatgctgtgatggttttgcccattccttctcaggtttcaggttctgtcttgaaatctagaatggagctggatacataatagatgacccatacatttttgcagaattaaactttaatgaattgaaatttcactcctaaccaaatgatacatgtttaaagataaaagctcaaacttcaaaatggagctgctggtacttccctcattcttcctaaataccagagatttcagtctctgtaatgcatgtcactccaataggtggaaagggtgaacagggtcatttaatgacccgatactgttctcagatcatttttgttagaatggccattggactagggaggtgtctaaaaaccataagggctgtgaacaggatgccaaaaacaagccaatagctgatgtggcacccaatgggaatagggagaaaaagactcagtagctaggcattcttgcttcttcccaatgtacttttctgacatttgggctttttctgttttgcccatagctcaccttaaccttttaattttctttgtctgtgcccagcacaagtttactttctagagcccatttattgacgtctctggtttatctgcacatttcacaatcttttctagctgtttaataaaggtcatgtttatagctttagtattgatggtttgcccagtaggccaagtgtcagcttctgtaatgtccaatagaatcccttcccataagacaaagtcctaagatgttactcaggagtatgagtttttatagatccaaataatgacttttggtcttcaaaatatatcatatgttaataataataacttactacattccgatcattgttcccagcactttcttaatcttgataccaaccaagtgagacaggtacttttattgtcctacttttatagatgagaaaacagaggcacagaagtcaagaagctggtccaaggtctcctagtgattgctggagtcagtatgctatgctacttcccatgtgtgctatgtgtaacacttatgggtcaggccctgtggtagctagcgggattttgcagtgagcaagacagtttttaccctcttgagttcaagagttccctcagagaaccctccgccctcattcctaccattcatgccttaatggagacggcttttaaatgaagcatttgtgtaaaaatttcacagccccaagttaactttgtatagtatggtttaattgctctatctaggtgcatttcagacccctacgaaaaccaaacttgcatccccaggaatctttgatctcttgggctagaggaaaaaataacaccaaaaagttcctttgggaggaagagaattaacgatagattgaagcttattaaagcaatgaattgacacctgtgaatgaaaaccagatgttgaaatctctggggaaaaaaagatatgtaaatgtatacagggtatataatgaaccttaagagcatagataatagtaaaatgtagtaagataggaagcgatgacttttgagtattcttgtttttaatgtaattttttaaacatataagtacatataatttaattattaataatgaccatttaacaaccagctcacaaaatttctgaaaacttaacagttggcttttgagacccagtgggagccgtctgacacctgtttatttatatacacaaagaagttcaattaacattagccctgaagactcatatcactcagctccacctcttcacctggggtttggaggcagatacacttgagctctaactctcactctatattttattaaaactgagacatcaggcaaattactgtttctgagcctccttttattatctgtaaatataatataataattgtgaacaattatcttgtgccaaacacagttgtaattcaatgaatttctcaacggggagatactgtaattcctcattttacagctgtggaaatagaggagtagagagggtagatagcttgccccactgagaagtgaaagaggtgatatatgaacaaaggcattttggtcctaaaacatgccgttctaaccatctcaatatactgcctacgttatcagttatgaagatgaaatgacatagcatatttaatatgactggctcagtgaattctcttcaattctcttttccttcttcctatttagaaaataagattaggggccgggcgcggtggctcacgcctgtaatcccagcactttgggaggccgaggtgggcggatcacgaggtcaggatatcgagaccatcctggctaacacagtgaaaccctgtctgtactaaaaatacaaaaaaattagccgggcgcggtggcgcctgtagtcccagctattcgggaggctgaggcaggaaaatggcgtgaacccgggaggcggagcttgcagtgagcagacatcgcgccactgcactccagcctgggcgacagagccagactctgtctcaaaaaaaaaaaaaaaaaaaaaaaaaaaaaaaaataagattataagattaggaccacaaggtgttgttgggaatgtgtcagaaaaagggaacactgcaatctagtgatggtctcaatcatggtggcacagaaaaatcccctggggcacttttcaaaacatagatgccttggccacaccctgtactaattaccataaatccgaactctaggggtttggggcatgggtattagtgttttttaaaagcttcccaggtgattaaaaggtggttttctacttttagaattcttgataatggtactctcttactcctgtttgctgatcttttccttttttctcataaacacagtaagaagtactacacagaaaagaggtccacattagggaccaccttaatccaaacagaaaaattgatttggatttccttaacaagttactgcaaagcttataggtttgttagtggaagttccactttatgaaggcagattcctgctgatgtagaaatatgtaacctcattctacagtgagctgcagtcatcgtataggatcttacaaaggtttagttttgcctatcatttaatgatttgtgcgctttgtccccatatttagttgtataatttaaaaattattgtgaaatttacatatcataaaattgataattttaaagtgaacaacttagtagctaaggatgtattcacagtgttatgcaaccaccgcctctatttccaaaatattttcatcacctcaaaaggaaattgcatacccattaagcagttactccctattttccctggtcccttctctccttcccttagctcccagaaaccaccaaactgttttctgtttctaagaatttgccagtcaggatatttcacacaaatgggaattgtaccgtatatgacctcttgtattttgctttttttcgttagcataacgttttcaaagttcatttacattgtaccatgtgtcagtagttcattcctctttgtggctgaacaatattctcttgtgtgtccatgtcaaaatttgcccatccattcatctgctgctggacactttggtagtattttgttgaaaactttttttcatttatattcatgagcaatattggtctgaagttttcatatagtgttctgtctggctttggttcagagtaatgctagcttcatagaatgaattaggaagtatttcttccgctgctgtttcttgaaagaggttgttaaggagtggtgttaattcatctaaatgttaaattcttttaaatgttttcaagccacatggtcctgagcttgtctttgatgggtggtttttgattactgacttaatctctttacttgtgagagacctgttgatattttccatttcttctttagtcagttttggcagtttttgtgtttctaggaatttgttcattttatctacattattcaatttgttggtacacaattatttatagtattctcttataatcatttttatttctctaagattgagaaataaagcttagagaaataaaagtgggataaataaatgaaataataatgttcataaataacatacttatattgttataaataattatataataatatttatgtaataatgttcatgtataatagtgtttatagtgtttcatgctataaaacataatattcccactttcatttatgattattgtatattttttacccttttttcttagtccagctaaaggtttgttagttttgttgaaattttcaaagaaccaatttcttgtttcgttaactgtttgttgtttttctaatctccatttcatttatctctgctgtaatctttattatttccttcactctgttagctctgcacttagttttctgttctttttctagttccttaaagtgtaaagttaggttattgatttcagatcattcttttttataatacagattttgtaactattaatttccctctgagcactgcttttgctgtatcccatgaattttggcatgttgtattttcattttattttaggatattttctaatttcccttgtgatttctttggcctaatagttggttaatattgtgttatttaatttttatgtatttgtgaatattccagtttttcttctgttattgatctctagcttcatttattgtggttgaggaagatactttggatgacttcaattttttaaaatttatcatgacttgtttagtggcttaatatgtagtgtatcctgtagatgttccatgtgcacttgagaggaataagtattctgctgttgatggtggagtgtcctatatgtatctgttggatgtagtctgtttatagtgttgtccaaggcctgtatttccttattaatctcatgtctaaatattctatttattgttaaaagcagtgcatggatgtcttccacgattattgtataattggttgcttttccctgcaattctgtcaatttttgctttatatatttggttctctattattaggtgcatatatatttgtaatttttttatcttctttatatatttctacttttatctatatatagtgtcctttttgtaacttgtaactttttttttttttttgagactgagtctcactctgtcgccaggctggaggcagtggcgcaattttggctcactgcaatctctgcctcctgtgttcaagcaattcccttgcctcagcctcccaagtagctgggactacaggcacgcaccaccacacccggctaattttttttattttagtagagatggggtttcaccatgttggccaggatggtttcaatctcctgacatcatgatatgtcctccttggcctccgaaagtgctgggattacaggcatgagccaccacacccggccaacaatttttgacttaaagtctattttatctgattttagaataccacctctggtgtcttttagatatgacttacatggagtatcttttctcattctttcactttcagcctatctgtgtctttggatctaaaatgagtctcttatcacagcatgtagttgtatcaagttataaaattatatatattttactaatctctagctttttgttggagagtcatttaatttacattttaaataatttctgattaggaaaggcttgcttctgccattttgctatttgttttctgtatgtcttatagccttttgttcctcatttgcttctctactgccatattttgtgtttaactttttgaagtgtgcttttttgatcccttttccattttcttttgtgtatattttaaagacttttctttgtggtttgtatggggataacaattaaaatcctaaatttataacaatctagtttggattaatgccaacttagattcaataggatatcaaagttctgtttctatacagttctctcctcatgttaatgtttttatagataacatctttatacattgtgtgtctgataacatacattataattattgttttatgcatctgtcttttaaataccataggaaataaaaagaagagatacaaacaaaaatacaataatactggcttttatttatcatgcagttacttttactagagcgctgcatttcttcacgtgatttcaggttgctgcctagtatcctttttgttaagtctaaaggactccctttagcttttctcataggtcagttttacttatgaatagctcctttgctttttgtgttggttttcctggaactgtcttaatgtttcctggtttttgaaggacaattagccaaacatagaattcgtggttgacagttctttgcagtactttaaaaatgttatttaacttcttctatgattttgataataaatcagctattaattttattgaggatcccttgtatgttggatgaattgcttctccttggctgctttccagattccttctttacccttggtttccagtcatttgattataatttgtcttagtgtagatctctttacagttattcgtcttggagtttgttgagcttcttgaatgtgtgcatttatgtatttttcaaatttggaaagtgctcagccattatctttacaaattctgtctgctgtttctttttctcttctccatctggggttcttatgacatatatgttggtgtgcttgcttgtgttccacaaatctctttgattccattcatttatctttaaattcatttaaatttaaattctttggtaagtttttcatgttagttattgtacttttatttccagaatatctgtttagttcatttttataatttctttatctttactgatattctctacttgtttatacatcacattgctgatttcctttagctctttgattttttaaggacagttgatttaaagtctttattcattaagtccaaagtgtatgctccctcaagtacagtttttgttaatttcttcttttgatggggcatagtttgttgtttcttgcacacttcatacttttttggcttaaaactgggcatataggccacgcacagtggctcacgcctgtaattgcagcactttgggaggccgaggtgggcggatcatgaggtcaggagatcgagactaacacagtgaaaccctgtctctactagaaataccaaaaattagctgagtgcggtggcgggtgcctgtagtcccagctactcaggaggctgaggcaggagaatggcatgaacccggaaggcagagcttgcaatgagccgagatcgcaccactgcactctagcctgggtgacagagcgagactctgtctcaaaaaaaaaacacacacacacaaaactgggcatataaaatatgataacgtattaaatctagaaataagatttttccttctcctctgggtttacttttgtcccttgctatagcatgtagctatttgtttaatgactttttgaactaattttttaatgtagtattgtttttcatgtgtgttctctgaggtctctgttcctttagcctttgttcagctagtgtcttgatagagaataacttcaataacagaaggcaacagagaagaaacaaaagaaaaagtaaaaactttaaaaatcaagaaaaacaaaacaaaaaacctctcctaatgtttacagattggatctttgctgacaaacttcttcaacactttgctaggctatttttaagctctgtcttagccttcatttcctgtttgcattgatcctagagatcatctaaagctgaaagaataagtttttattagcgagcatgggcatggatttttttaaattcttcggtatacatgaatgctatacatgtcctatttcccaaggaaactctttagttcttctgcctgagctttgggtactctactatatgccccaactataatgtttttgtcttaggtagctgtggattttttgtttaccttacagtattttcaaggaatctctgctgcatttctcctctgaaggagtcctcagttagagaaacaaagtaaggtgctttgcgttattccccaagggatttcccatacaggttatagcaaatgtagttttttgcgagtaagattgtctttgcttcctccagaaccaaggaccagggttgcctactggggaagctacctgcagttttgaagactgctgtcaagccaaggagagagttggagcaggggcaaatacaaacatcacatacttttcttactgtttttaagtctcctttatcttttatttttaatattttggtttcagcattttcttggttgctatcaacctgcctattttcaagagttttgttagagttgattctgacacttttgcttgattttgaatatttctgtgggaacacaagctcttggagctacctactccgtcatcttcactgatgtcacttgcagtttactttcagggctttagttatccacatggtataatgtgcactgtccgttgaatactatttcctatttaccttttttctcttatttaattatttgcatatatttattttagaatatatgtactctaggtcttctctttacttcatgaaatctaccacctccataaaaaaagatgcattcaaagtagacttgataaatacttaatgttaaaagattttctttcacatagtttcagatttaataaagcaaaaatgcaatttcaaaaataatctttttgcaagttttgaaaaattctggctgctgaaaataaaattgaattattggcaaaggcaggaatttggaatagaataaatataaacttttgtgatgttaaaacaaattgtttcgttgaatattctttataagaaacaattaccatagagtcttcaagaccttattattagagataaatggaaattaatttatctcagctattatgaaaatgtgattttaaactttaatattaggtagactgctgctcaatagtttacaaacagaggaggtaagaaataattttggataaaatattaatgtatgagttataattgaattatcatgttatatagtctcttttaataattagcagttaatggaagaaaaaagcatgttctcattaataaatataaaaaagcatttaagttaaataaaagaaaaaggtagcttttgaggaaacttcagtctgaattgtccaaatagactgaaaggactttaagggcaaaattttgtttgggtttgggaataccaaaatttaggataaaatatttcttttatccttctttttttgttttgttttaagagaagaaaaaatttacatagactctttgtataccagtgagaggaagtatagcatagaaggccatctaaaggatgaaattcccataaggagttttctgaaccacttatatcaactggtcagaacttagttttaattaaatttgctgggctggggatggtggcaggacaatagcctgttttaaggatagagagccagctttaactttaactttgaatttcctggctccaatccattggtgtcactacttcagtgttatttaaatgcaggattttccatttaatttccttttaagggagataaaaaccacagtttctttttcagaaaactgccaaagagtctccctgtgctttattaagtaacaattgcattttcagtagagaaatgcaatctaagtggtagcacattaaaacattatagtgtaaatgtgcagatgaaaatactaaaaattaaataattattattcatagcagttaattcagttatatgtattttgaactcagtgggaaattgtttatacaacagacttaggatattaaaattaagtttaaaaatttgatttatttttataagacagacaataccaaaactcttttttcccttttatgccttgtattagttataatgtttgctcttacattttgtgactttgagcaatttatacttcattatacttaaaatagaaaaattttaggccaacttaattttttgtaagttttataaataataacttttgccaggtgtggtggctcatgcctgtgataccagctctttggtaggctgaggtgggaggatcacttgaggccaggagtttgagaccagcttaggcaacacagcaagaccccatctctacaagaaatttttaaaaattagcaggatgtggtggtgtgtgcctgtagtctcagctactcaggaggctgagatagaggatcccttgaatgaatccaggagttcaaagctgcagtgagtcatgatcatgctattgcactctgcgctgagtgacagagtgagactccatctctaacaacaaaaaaaagaagaaataataactttgatcatattttgtttgtatccatttgaatatctgcctttttatttttagtaatagagattttaaaatatagattattttttaatagttgacctcaatttacatacttgaatagtgagcatttactatattaaaattattagaaatcaagtgaaggaattaagtaactaaataaagtgacttttaaaatctacctgatatttctgtgtttatgataggctttaaagaagccattgctagattgccttccatgaaagccatttgtgcctaggttctctcttccatgattgctcttttcttttcttttctttttttttgaagaatgggaatgaagattcccattcttcagattttagctcaggcatcaattactcgagggccttttctgacctcccttaccacattagctccccccaacccctctgtatgttctcataacattatccttctcctccccagcattcataatagtttctagtttgacttctttgtgattatttgattaatgtctgtttccttgaccacgttttcctggtccgtgagggcagggaccttgcctgattttgcttatcatcataattcttgagccctgcataggcttggtccagaagcagattccagtgagtgcttgtgtgttgtatgaacgctgtactcggaagtactacatcatgctgtcctattttatgctgataaatgaacttcaaataattttactagaaaaaacatttatttattatatgtatgcaaaataagtcttaattaggaacattaatacagatatcctaaataaaatattagcaaattatatctagtagtgagcatatcaaaataataatacagagagtaatactaagactgtttcagaccagtaaatgaaataatgactgtaacatgggaataaaatatagtttggagatttgatagaaaatgtccatataaagtcttttgtgccttgtgtctttttagtggtatatttttggttaaatataaccaaaaaacaggtatatttaaccaattttcttggttaaaaatgatcgtattctaaatatattaaagaagggatatgtattaaattgtttctttgcttttctgattcaattcctctcaccgttacccccagctctcagccttccatctccccattcctttatttcttagttatggtagacttccagacttccgataacacattcctgttttttttggagagttccactaggcatttctccacatggctatctacttaggctttaaaaaagtttctatccttggatttgttttcatctagtccatatccaggtagaaaaagatgtgatcaaaagatttcattggttctgtttgctgtgtcttctttctggtctcgccttattctaccatggctttataactgtgtgtcccagtgtggtttgttttgaagctttctcctccctggggcatactgtcaaaattcatttatagtgacccacacttagattttcttttgtaagtcttcaaatattttgccattccaaacactgccttaaacctactaaagactctctatagtctctaagggacacatgggagaaacatcactggtatacccttcttgacagatatgtaggtgaaagataagaaaataaatcagcaagtggcggttgctctttcagcagccctgctttctcagactttccaaactaccaaaatgaaaaaaatacagaggaaatatttagtgcccttgcttttccatgtgattatatatctggtaaaatttggcatatataatatgtatgtttaatttccctcctatttttaatatgagatgaaatgtaatacatttgaattatgacaacatcaagaggttatttagaccaaaataggttgtattatatacaaaaataatggcaaatgttatgaattgtctctagtatttttttttaacgtgtgttttaaaattgaattggttgggagactatttgaatgtgctttacttatgtggaaaatatcatcgtttactatttttctgcagatccctcactctagcccctatacacataaacaccaaataatttgcttccattgagttagcataaaaatcatcagggcttcaggataaatacccttaaagtaatgcctcagaatgtgcctttttgtggaaaaggttaatctagcctattattggcatcattagaaaatcttgaaaatagaagttcacagtttctatgtgaagtgctgcattaattatgcagcgagagtacacctaaatacaggaggtgctcacatttaggagtagtagccacagttacgcggtgttacactagctctacatttgcacacatgctccttgttttgtttattataggctttccttagagaataaagtgttgcaaataaatattgcatgtgtatgtaggcagtttttgtttaataggtattagagtaaatgactgtgaatttgttcctaagaatcttctgtgtaaaaagagataattttatcatcttatcactttatctctaacattaaaatggtaatctttgcatgacattatttacttgcgattgtgtagaccctgaaaatagtgtatattatatctataaattattgtaaggaatattatattactgaatgttcaacactaattatacttttatctccaacttctttagagcttaatgtattgatttatttacacttatagcttctaacaaggtatattctaaaaagtttttacaaatcaaaaaatttaactagtttcttaatacacaaaaagcctcagtacaaatgacccgatgaccttaattcccaggaaactgtcacattacttctttacccctttgtctagcttaacaatgtgacccaaaatactgcggagctttaaagtttctcagcattgtaaggtcaagctttggtcaccatagttacagtttagatctgcaagtcagaggtcaaatagattaatgatgtcagacacatctttaagtggttctaacaccacttcaccatgcagtaaacagctgagcatattcgatatggcaaaggtattcttcagtcttgctaataagaatatctttggagatattctttttctgatagaaagatttttttataagaacttgcaatattgggctgtggcatcagcaataatagttggcttttagatttgtaatatcagatgcatattgaaaagtatattaaatagctcagatttacacttttctgcacgtctgtgttttgtctgtcataatcaaattgatcatccacctatttataaataggtatcctcactcccctattaatttatggctaaccatgacagtggaccgaaaaaaacaagctttttgattaggagtttttgctttttgcgtgtgtgaatggcacatctcttttctcccaatttgggtagtatgcgctttaaacagaattatttagaaaattgtgtttgggaaatctttctcacattagagagcaggtaattatccatttgtattttatatccaaatacctttatttatagcctaggactctttataaagatcatgggttgtatattcactttttttgtcctaaaaggaaattatttcctcccttttgaatcagaatggaaggagaaaaaagaaactattttacagtgaacgttacttctagaaaaattcaaatgttattttttacaaataaaaaatactctatagataaattttaatcaaaaatcacagaaatacaaataagacaaaaatattaagtgaggtgaaattgcaattattaataaaatatatttaagcaaaaacaatcatcagaattttactatagaatatatatatttaaagctttgccagtatggaattttgcagccagtagacagaattatgtttaagcagtaggcttaggttaagctaaacattaaaggataccctgtttctgaaggttttgtttcccatgtgtattttgtgcagctgtaagattttaagcttgctggagcatttgctcttgatcacatactataaaggtagacaaaggggagaacgaagaggtttggcagctgggaggtgttattatggaatttaatagcaaagaagatgggggttggggcttttctaggtgaaacagagattggcagctgggaggaggaaataagtcctggagtctgagaagagctagtagttcagttgcctgtgagtttcaaatgacaagctagctttcatgtgaatgaatggattgtctccggttttgcgttcaattcaatggaaatcactgccttgtagatatcgtggaaaccaacaactcagcaaagacattaattgctgacctgttttgcagcacttagggccattggttcaacaaactgatggagtattctgtttggtcattatgccaggagaatggcaaatcaatatttaactaccttttgaagaagctacaccactgaaatgctggttttgtataaaactgtttacacataagagtgtcctgaaatgcaagaaaaatgattttattctaaatgtagaaaaattttgtaatcaaataaaatatcaggttgagttctgactttcagaatctgaaatagtattatttctgtaaaaattgccttatgccttgcttttagatttcttgctcctgatgcattgttaaggtgggtaaaccaaccaatacttaatgtctaaatatttatttatcaaaaatatatgaaattggagatattacattttatttactcttcttccttaaagtctgcttttcttgtctacttcctatgcctttttatttaaattttttcaatttacacctttacacttttgctagtgtcgtgaccagaattgtacatatattgctactgtagtgcattagtaatagtttccagtccttggtgcacatgaaaatcatgtagtgaacattaaaatcacctgagcataatgcccagacccacccaagaccagttgaaataatgtagtgaaaagaatgcaccctgtggggatgggtgtagtggcttatgcctataatcccagcactttgggaggccaaggtgggaggatcattgcgccctggagttcaagaccaacctgggcaatatagtgagactccgtctctacaaaaaattttaaaaacattagccaggcatggtggcatgtgcctatagtcccagcttcttggagggctgaggtgggaggatcgcttgagcctgggagattgatgctgcaatgagctatgatcatgccactgcactccagcctgggtgacagaatgagagcctgtctcaaaataataataataataataataataataataataataataataataatgtaccctttgactctttggaaccatacttccctttggctctggttttctcacataatagccatgtgatattgggaaagttacctaacctccctgaatctgttttcttatctataaaaggcaataatattaatactaaatttgaaagatttcttgtgaggattttataaaatattggcataacttccagcctaatccctggcacataggagacatccagtaaacaataataaatatcactgtctccaattagcttgctgtgggaccttgagcaagtcactcctagccttttctggccccatttctttacctatataatgcagctgtaatacttgtcaatctcagagtgcttgtgagcatcaaattacagatgtgtgttgaagggctttgaagaatagagagcaatatagtaaagcaagatgtagcttgtactcttattgctaaggctcctagttctaaggctcagagaaaacaccatcaaaatttgaaactgtttgtgggcattcaatgcttcatttatcattttctcagaaggtttcctgggatgctctaatgagttgcagaccacaccatcactcctgtgttattgaatacttagagtgacaatatccatgaagatttttcaccaccttgtcctgtcactgtttggaatttgtctcatcactatctatcatatagaattaatgcagacttgaggattttccttagctttttgcaaccctgtgcatccctcttggctacaaatacaatttctgtagaagagacaaatagccttgaggctgctccctgcctcctttctgagctgatcttggtatttcttcacgtgcagatctttttagaagcccaaggagagagtcagatgccaactaagttggatttggctagaattgttcacctattagcattttgctttacttaattcacatttgtatagcccttagcatgttctcttatacttacagactttttttgcaatgagtataactttatgttgttaattcacttttctgtggatctgtgtcacatataaagtaccatgtcaaatattgttagagcttagtagttaccttcgagtctgtaaaccaacagctctgtgattgaccagaagtcggggctccaagtaatagaatttctttgttttccagtagtattggacatcagtccatgatgtgcattcataagagtgcaggctgtacctgcagtgaaataattttgcatgcattttatattttacatagcatatatagtagtggttctcaaacttagcatgcatcagaattacctggagagcttattgaaagacaaattgctagaccttacctccagagtttccatagtttattagttttagcgtgggacctgagaatttgcatttctaacaagtttccaagccctgcaactgctgctttggggacaataatatgggacccattaatatggtgagtgctaaggtgcactacacagattcccttttgagagtagagcattcatttcctaactgcaaggggtactggctgtcatggtttccaggccctctgggagttgccctcagttgatgggcactgcctcacttaaaactccatttctgtccctagttgtagctcacataaaatgacaggttaatgcagggagtacaaaggcccatccttcttgcttcagttcaggataactgaggggccaccccagctcagaggcctctgctgcaattgcatcacagctcagcttttctctacttaatctctcttcccttactcccaagagcactctctgattaacctgtgtctcaaagtcttttccagagaatttggcctgcagcagtaggtaataaaagagagttgtatttgttaagcacatatctgacagtaattaaatatcacaactccttcttgtgtagaagcatgaaggagtttgtggtggtttatttggtaatccatgaggccggagcccttaactactatctctcctatgcttcagcatgtcagtcctcctctttttagacatatttggctattgtcttccttccagttcatcagcattcttgttgcagaagctttcccacaatagccatttttagagtacacatttgctccatttcatttacaacaaatatttttcaagacaaattccatgcctctcatgaagcaggttgttgttcttcagtgggttagaagtgggatgattcctccaaatctaccctagaatctcagatgcttttctccgagcactttccccaataataataatgactagcattagtgcttcatatgtgccaggtacttgactaagtactttagagatattaactctttgaatcttcataacaaccctatgaagaagatactattattcttattttagaaaacaaaacaaaacaaaatgataggttaaataacttaccagggtcgtataattagaaagaggtggagccacattttaaatccaggaagattggctccagaatctgtgcgtttcacctgtatgatgtgctacaaattttcccatctgtgttatcaggtggcagttatgacttttttgttgacataaatttttaacagctttattgaggtgtaatttacatataatacagttcacccatttaaagtatacaattcgatgggtttttgttcattacataattaagcttttaattgtaagaaatatataaataaaatgagctattttaaccatttttaagtatgcaattcagtgacaataaatactttcacgatgttgtgtaaccatcagtagtacctattcaaacctattttattagcacaaatagaaaccctgtaatgagtaaacaataattccccatttttaccttaccctcagcccctggtaatctctaatctactttctgtgtctataaatttgcctgttctaggtacctcattcaagtaggatcatacaatattcattcttttgtgtctggctcattttgcttagcacaatgcttttcaagtttatcaatgttgtaccatgtatcaaaatttcactcctttttaaggctgaataatactctattatatttataggccatattttgtttatttattcatctgttggtagacacttggattgtttctaccttttggctatgatgaataatgtggcaacgcacattattgtacaagtatctactttcaattcctttggatctgtacctggaagtggaattgctgggtgatatggtaattctatgtttagtttttaaggaactactttaaaaaccattacattttctatagtggctgtaccatttacattcccaccagcaatgtatgagggttcaaatttttccatgtcttcaccaacacttttcttctgtttttggttttagccatcctagtgggtatgaagtgatatctcattgtggttttgattggtatttcccaaatgattaatgatattgagcatcatttcatgtgcttatttgctatttgtatgtcttctttggagaaaagtgtgttcaagccctttgcccattttttagttgggtagagttctggatatttaacactcatgtgatatatgatttgtaaacatttttcccatttaataggttgtcttttcactctcttgagagtgtccttcggtacacagagtttttaattttgatgatatccaacttgtctattttttcttttttgtgtgtgcttttgttatcctatctggtactcaattgccaaatccaagatcaagaagatttgcccttatgttttcttctaagagttttgtagtttaaggtcttatatttaagttgttgatccatttggagttaatattagtatgaagtgggagtccaacttaattcttttacttgtggaaatttagttgtcccagtgccactggtggaagagattattctttctctattgactggtctcttcatacccttgccaaaatcccattgaccatagatgtgtaggtttattttccagactctcaatctgtttcatttgcttatatgtctgtccttatgcctccattatactgctttaattattgtacctttatagtgactattgaaatcaggaagtgtgagtactccaaccttgttctttttcaaaactgtttttcctattcagggctcttttagaatttactatgttatgcttttgtacttatcagtattcagtatttatttgtccaggcttgtattttctcttttattttgtattcacatagtggctatcaccttagaaagatttctttgcaagctgttagctaatagttcatctcctgatttataactctgctagtacaagtctatgctttcttaaacacagttccctaatccaaaattaaaacctgtcctgaccagaagctttttggaacagagactgatctggattgatataaggttattttgccttttaaaaaaatcttacctaatatgaatattcatatcttttacagtagaactattcatatatttgaatagactaagctatctgagaccttacaatggatattatatattgcatgtaaactgtattttggtttatttcccttattaaagtgaagtgattctaaatcttaaaacacattttgccctaaggatttcaaatgagtgatcgttgacctggatttttatttttgagatatatcaagaaaaaaatttccaatgaaaatatgataggtcctgtgttagagtagttcttataaaatttagtgatctttgttatgatctttgtttcagttgttatgaaagaatagttgtggtcaggtaaatctttgtggagtaaagcttgatatattgggaagaactttttactaacattatttatcacttacaaggaaccatgcacattataagaaggaagatagtagtagcagtaaaaaatagcagtgagcggtgtttcctatatgaatgtgttgcatgaagaatatgtgtgcttatcccttcatctaagaacagattctttgtctctattatgtttacaccaaaacccaacactaagattttcttcaataaaaagaaaaattctaaattcagccctcctactcccatcctttgataacactctctgccttgactggcatcaagtctacttgttgaattcacactctcaagaggacaggaagaaagacagacagataagagagacacttgtctcaatcatatagtttcatgaactaacaggtttttgaagtcctggctctgaagaacatggtcattaggtttccaaaatcaaacttgggcaataaaaaggatattgctttgtttgttttggtaccacatatactataatgggattgatttttttttttttttttttgagatggagtctcgctctgtcgcccaagctggagtgcagtggtgccatctgggctcactgcaaactccgcctccagggttcacgccattcttctgcctcagactcccgagtagctgggactgcaggcatccctgccacgcccagctaattttttgtatttttagtagagacggggtttcaccatgttagccaggatggtctcgagctcctgaccttgtgatccgcccgccttggcctctcaaagtgctgggattataggcgtgagccaccgtgaccatacaggattgatttttgaaaggttaatctgggccaggcgtggtggctcacgcctgtaatcccagcactttgggaggctgaggagggtggatcacctgaggtcgggagtttgagaccagcctgaccaacgtggagaaaccctgtctctactaaaaatacaaaattagcggggcgtggtggttcatgcctgtaatcccagcgactccggaggctgaggcaggagaatcgcttgaacccaggtggcggaggttgcggtgagctgagatcgtgccactgcactccagtctgggcaagaagagcaaaactccgtctcaaaaaagatataaataaataaataaataaataaaaggttaatctgaattcttttttaggggtgacctaccgatttgccaagtattctatgttttcaaaaaggcagcctgagaaatttcctgacttcagttattcttgaaccaccttcagaacttttaccataactgagtaatcttttatgatctttcatgtagtgctatatttgttatcttgcttaaaaaaaattgcatttaactgtcgtaaaagaaaaaaatcaatattttccaaataaatatgtaacaactaaaattaaaaatgtacatatgtttgctacctaaaatcacctcagaaaccactggaaacaaatgcaccacacttttgggaacactgccctaacgctaagtctcaaaaaattgatgcgttcttcaagaggatgtaagaattggagggaaaagccacaaatttttcttttaagtctgggattaaaaatgcattcttgctttcttagtttaaaaacaaacagctaagtaccaattgaagggaccaccatggaagtccacatatagtttctgcacttgtcattttatagaagcaatctctacatctccgctgccccagactgaaaatttttagagcagtaatttgtcataaccgttttttgtttttttttttgctttttttttggaactccgtgacgataggaataaatagtaaacaaacaaacaaaaacttgtgcctcttgttccttcgtgaacactgaagttgtgaataaaatgataatgtagagtttgtaaatattcaaatttggacttctgtctttcatgttaaattgccctaggcacttggactcaatttcagacattagtcatctgtaaaatagaggactgacgatgctagccattgatgccaaagggatagaaagactttatgcatatcgagttctagaatgacatagttggctatgtaaatcagtttgcctgatttatcataacagtgcatttaaatacaatgttcatgaaatattacaacttgtaattagaaaattgatgttggttagagaaattgtgttgactttgtcttttctaaacacttcagaaactttatttattagctttagaggtagatccttcaattaagctgacttaaagaggtaaaatgaggttattgttagaaataaaaaccaatttttcattaagttcaattaagttcagtttctcctttattatgcttgtatttaatagaataatttatgtggtatttccattaaatcatttaccagggttttataacaatatgttactagtgtttggaaatataaatacaaatctcttataattttcaatttgtgcttatattaaccattcatttcttaagctttgatcatttaaatgctttatttactagttttcatatgcttcttgtaaacctagtctcacattaagaggatgcttaaaatgccaaaatgccctggtaaattaaaacgaattcatcgtatttcttacattacttaactctgatgactacagtctagttgatacttgtaggattcaaattcataaaacctgagatattcagatcaaggagaggatagccattgggaaatgagttttttattcttatggaactgaaaaatgcggtatcacttgaaattattagtctaaagtttgccttcacgtgactaatattgggaaaaaaagtttttaagaaaactttggaaaatcaacacttttaaaattttatatttggcaccagacataattggcactaagaaaggaaataactaaagttgtgttaagataaatacaaatgttttgtttccatcttaagaagggtttttgatgtcctctggtgtagatatttactggagagaaggctattgccaatctacattccattgcagttgattttaaaatatagagctaaacaggaaatgtcatgagtgatgtgaccatctgccaagtgtaaatggagtctgagcaagtggatgtaatctgtactaaacaagcaaatgcgttggagtacagcctgaaagatttttaaatcatgaagctacaagcccaatatataatgtttattttacatactagtaattcttgtgcaattgggtttattgtaactcttgtaacaactgtgataatttttgctaagtgaaattaaacagcatcttattccagtttcagagtttccatctgatatactttagagtgcttggaattctttggtagttcttttctgaaatccttaaagttctttccctgccaagaaacctgttttcacagtaattataaatcaggaatgcaggtaagaggaaagaagaaacacaaaagggtgctttatgtaatcccacccctctgctctgttcaaaggtgccaaaaagaaatcagggattgttaaaactcatactgaaggatttatagaagccatcaaattggggacaagttacaatgaaaacttttcattgtaaatgcactcagctaacagcatgatatctcattttaataatcaatggagaaaaagttctttcaggcaaagtgtattctaaagtgatttttttcccttatggaaacatagatagaataatcatttaaataaagctttaggagtaaaatgatacactattattttagttatacatgttatatacatttttattgaaatgtagatggctacacctttatcaaattacagttttattgtttcagtgttgtttacattaacttccattaactctgttgtgattcatagtttaaaatgggccacaaaaattacatttatcatttcacaaatttaaaaaagtatcaacgtcgggctatcctattcctttaatggaccagtttaatgcttagtaacataaccctttaaagtctacatgtcaaagatagcatttttacttgaagaaagtaaacataaaagaactttaaagttttagtatctgtttccttaactgattttaatggacttccaaaacaatcaagggcagtgggtggcctcttacttgcagaagccaatttttaagtgcatgtgtttcttttccatgttgacctcttgctgggacatatttgttgtcttttaaaatgatatttgctaaattagcttattgaaatgctaaatcatgatatgttgcttttcagccatcaatttgaaattccacgctttataaatttcaagtgatttaaaaacactgacttttatattcatgctcagataacaactgcatattacaaatgacttgtaaaggtgtgtggatcttccaataatgattgtattacttgcatgttattagcattaaagaacatgtatcatttacttattctttcatgcaaatgtattgaaggcatgtacatttattgaaggactgctgtatgagccaatacagcgtatttttgttaggtacctaatttgtgtgaggccctttgttaaatgcacttaatgccatatattatttagttttcatcataactttgatgtagtatactgtttttatcttcatttaccaaatgaggacatgaagacaataaagagactcacccaagaacatatttttaggaagtggtggtttaatgatggaaactctcatctgtctgactttatgtacagctatggtgcacagtagcagtctataaaatctatcttgtagaattcatggttttctaaaatactactgtggtgatgatagttttctctctattgaattctgccatactctacccacagattctgctttctcttctctgatggcaatatagtttggatatttgtcctcatgcaaatatcattttaaaatgtaatccccagtcttggagatgggacatgatgggaggtgtttggaatatgggggcagatcactccttaatggcttgggccatccccttagtcaaaagtgaaccctcgctgctctgaattcataggacatctgatcatttaaaagtatgtggcacctcttttctctctctttctctctctctcttgctcgcttctgcttttgccatgtgacatgccagctccccttttgccttctgccatgattataagtttcctaaggtctcatcaggagccaagcagatgcccagcatcatgcttcctgaacagcctgcagacacatgaatcagttaaacatctcttcattataaattacccagtatcgggtgtttctttgtagcagtgcaagaacagcctaatgtagatggcttttctctgtctcctttgcttcaaatgcagagaggcagtactagagacagaaactgcataaggctatggccttggatgacatcaccaggagtgtgtgatgcaaaaatcgggttgaggctagaaaccggagaacaccagtaatagaatcaaaattatgctttaaggacatgaatctaacagcaggcgtatctccttattgatgttctctgcttactcatacatcattctcctgaatttcttttttgtccatagttttcttcagctttttcaacataagacaattaatttaaagtctttttatagtctgtccaaggctaggcctcctcaggagtagtttctcttttacctgtaaaacagtatgaatgtgccatacttttctgtttctttgtatgctttgtaattttttgttgagaactggacattttgagtatcataatgtagtaagtgtggaaattcttccccctctccaaggattgctgttgttaacttgatgaaagctgcagttgtccatttgtttaacaagttttttctattttttttcaaaactatattctttgtcatgtgtggtcactaaagtctctgttccattatttttgcagtcagccagtgatcctacagagaattccttgaatgcctagatccaataagaaaatagaaaaaagtgtctatctttttaagttcctttgacagctgctttagcccaatagggttgaaagaatggccagcctctgtgcttctgtgccggtttctcaatgaacagccaagcatataaaaacacacaagcacaattgttggaggacaacgtccttattgtccactctagcaccaacaagccataccaagtacatggtcttatctccctatggctgccagcttggagctggggctaaaggatggtagctgctttgtgaaatgccaaaattcattgaaatttgccatgcctctttttccctttacactctcctcatgttgcaagtgtctcaccagacttcagagtctgaaatactatagtttattctgacagttcttgctacctcaactgatttcagtggagacatcaattcttggagcttcctattcaaccgtcatctgtgacataattctattttccttttttccctttggttcattttaaaatttctttctacttttttttataggtgacttttatgtaagtaggtttttttttttttgagacagagtcttgctcagtcacccaggctggagtgcagtggcatgatcttggctcactgcaagctccacctccagggttcatgccattctcatgcctcagcctcctgagtagctgggactataggcgcctgccaccacgcccggctaatttttttttgtatttttagtagagacagggtttcactgtgttcgccaggatggtctcgatctcctgacttcgtgatccacccatctcagcctcccaaagtgctgggattacaggtgtgagccactgtgcccagccttatgtaagtagtttttattaatttggaattttaagtacacttgactctgaataatgtggtagttgggactctgatgtcaccccacacagtcaaaaattcatatatgacttgattttacaaaactttattaatagtctactgttgaccagaagcattactgatactgtaaacagttgattaacacatatttgtatgttatatgcattatatactgtatcgttgcaataaagtgaaacaaaatatcacaaagaaaatcatgaggaagagaaaatacatttacaatgctgtactttatttgtccgtaccataagtttacattgccttttcagaaaatgaattgtctgtcagaactagcaggccatctgcagccgcagacctcaatctatggcacatctcaagcaattctatttttttttaatgttgtgacttctctgcttcttgcaaggacttccggcatcaccagtggcattttatatgggtcccatggtggttattcaagatttatggtatcacactaaactcagtgaaaaatacatgagaactgagacacagagagagagagcagtttttgtttttcatttttgagatagagtctcattctattgcccaggctagagtgcagtggcgtgatctcggtccactgcaacctctgccttctgtgttcaagtgattctcctgcctcagccccctgagtagctaggattacaggcaccctccaccatacccagctaatttttttgtatttttagtagagacggggtttcaccatgttggccaagctggtctcggactcctgacctcaggtgatccgctcgcctcggccttccaaagtgctgggattacaggcgtgagccaccgcggctggccatcggccaattattattattattatttttttaaagagatagagaccagcgtagccaacaggcgaaacctcgtctctactaaaaatacaaaaaattaaccaggcatggttgcccttgcctgtaatcccagctactcgggaggctgcggcaggagaatcgcttgaacccggcaggcggaggttgcagtaagctgagattgcgccactgcactctgacctgggcgacagggcgagacttggtctcaaaaaaaaaaaaaaaaaaaagacatagggtctccgtcaattgcccaggccggagtgcagtggcatgagagagatcacttttaccatgacgtgcaaattatgggagagataaactgttcacatcgagatgattggccacactatgttttaagaagatacttgtaacatttgagctcaatgcaggggcaacgggagctggctatgaaattatgataatggtacagtgtacactacagttaatactgcatttttacatttgcttatatttctctcaatggcaaatggcaccatgtacaatctattagtgttaaattttaaccataagcatacttcaaaataataagagccatatatgacaaacccacagccagcatcatactgaatgggcaaaagctggaagcattacccttgaaaactggaacaagacaaggatgccctctttcaccacttctatccaacatagtactggaagtcctggccagggcaatcaggcaagagaaagaaagggcacccaaataggaagagaggaagtaaactatccctgtttgcagacaacatgatcttctatctcaaaagcatcatagtcttagcccaaaacttcttaagctgataaaaaacttcaacaaagtcttaggatacaaaatcaatgtgtaaaaattactaacattcccatacaccaacagcagtcaagctgagatccaaataaagaagaaactcccatttacaattgccacaaaaagaataaaatactagaaatacagccaactagggagttgaaatatctctacaaggagaagtataaaccattgctcaaagaaatcagagatgacacgaacaaatgggaaaatattccatgctcatggataggaagaatcaatataaaaaagaccatactgcccaaaccaatttatagattcagtgccatttctattaaactaccattgacattcttcacagaactagaaaaaaactattttaaaatttatttgaaaccaaaaaagagccagatagcaaaggcaatcctaagcaaaaagaacaaagctggaggcatcatgccacctgacttcaaactacattacagggctacagtaaccaaaacagcatggtactggcacaaaaacagacacatagaccaatggaacggaatagagaacccagagataagaccacacacctttaactatctgatcttctacaacctgacagaaataaacaatggggaaagattccatgttcaacaaatggtgctgggataactgactagccatatacagagattaaaactggaccccttacttataccatatacaaaaattaactcaagaatggattaaagaacttaaacaaatgtacaagaaacaaacagacaaccccattaacacatgagcaaaggacaggaatagacacttttcaaaagaagacatacatgcaaccaacaatcatatttaaaaaagcacaacaccactgatcattcaagaaatataaatcaaaaccacaatgagataccatctcacaccagtcagaatggctattattaaaagggcagaaaacaacagatgctggcaaggttgtggaggaaaaggggcacttacatactgttggtgggagtgtaattagttcaacaattgtagaagactgtgtgatgatttttaaaagacctagagacagaaataccatttgagctagcaatctcattactggctacatactccccaaaatatcagttgttctgttataaagatacatgcacatgtatgttcattacagcactagtcacgataacaaagacatggaatcaatctaaatgcccatcaatgatagattggataaagaaaatgtggtatgttacatcatagaatactatgcagccataaaaggaacaagatcatgtcctttgcagggatatggatggagccggaggccattatccttagcaaactaacacagaagcagaaaaccaaatgcctcaagttgtcacttataagtgggaactaaatgatgagaacaaatggatacacggaggggaacaacacacactggggctaatcagaagctggaaggtaaaaacagagaggatcaggaaaaataactaatgggcactaggcttaatccttgggtgatgaaataatctgtacaacaaacttccatgacacaagtttagttatgtaacaaacctccacatgtatccctgacttaaaataaaaattaaaaaaatttagccttctataagagatctgtgtatattgtagcaacatggatgcagctggaggccattatcttaagcaaattaacccagaacagaaaaccaaatattgcatgttctcacttgtaagtgggagctaaacactgggtacttatggacataaagatggcaacaatagacactgaggcctactagatgggggaaaggagggaggtggacacgggttgagaagcttactattaggtactatgttcactaactggatgatgggacatttgtaccccaaccctcagcatcatgcaatatacccatgtaacagatctgcatatgtactccctgaatctaaaataaaagttgaagtcatttaaaaaaattaagttttctgccttaggaatgcgacttctttttttttcaaagtaaaaataacctccatgagacttttcttttaatttcatttgttattctattcccatagaatacatttttatatttcatcaactccatatagactttctgagtcctaaatggaaactgagatatcttcaactagataattgaacttgatatatttcaagaattgttatgtatttcaaaattttacagatacaaatatttttatactagttccttttgtcctccctcccttccttctttcctttttcctctctccgttctttcctccttccttcgttccttttattcacatattacatacataatatcacttgtatgtgtaaatatatgcagttagacttttctgaaactttatgtgacttcaaaagattattctaattcattatgtagatcaaaaagctgatttcctttgagagggttttaaatattataaatgacttagtatgcagaagctggactttgccttgttatatatgataattaaatacttgatttcaaaatatataaattaagatggaaaattatttaaagattgtgtgaacctattattttaaagttacttaaaaatataatttctagtcatcagaaatattttatggttttgccatgagttaaatattagtccaaaatgaatctacattttgttataatgtatatgcctgtttggactgtctgttcctaaatttcattctccccagctctgtagtcccttagctctattatgtggctcccaatggagtcccaccttaggtttcttatattgacggcaacttggatgcatgcctcttaagctgacccatgcctgactctgccctgtgtatgaatttgtgtctgcttgtagatctctgcagtatagctctgggtcagaagcatttccatagttaacctcaagcctgtgcctgtccagactgtctgtggtacccatggatctctagaatactaaaggcttcactgacatgttgaatccaaactcaccatatattaagtaaaaccaggttgagatcttaaaatgtgtttatcctcccaacagtaagctttttagacccgagaaagtggagagatataagagagagattatcattacagtttagaggagtgtatctcattgaaatattgttaaatgagagctgatcaaaactaagatatggtttcacaatacatgtgaaacacatttaggtcaggagtttagaaaacttctgaatgagcatgttaacaagaatattgatatggagtctctttctttcataaggaatggaggaatggcaaacagaaattaatgtttgaagtcaataacctagtgtgcaagttctttatgatctaactccatttcattttataagcttctttcactgtctaccctttagctatgccaagggtcagaaaattgaatatattctgtcttccttagtgtatttgttttttctccttttcacattttcttaccttagttcctctgcctggaatctctttctgctcatgactgtaagccatgcgtaatatctgctctttcagactcagatcatcatcttgtgcaaagccctcattcctccctttctttcccagctcctctctcccaccaacacagaagtaattcctctttcttcttaattcctactgaaattttggcatgagtataatttcttacagttttatatcatggcttagtctcattattgcttgccatatgtgaggggagttgttatggactgaatgtttgtgtttccccagaattcatgtgttgaagccctaatcccaaacgtgattagattaggatttgagagtctttgtcaggtaattaggttaagatgatgtcatgcgggtggagccctatgttaggattactgtccttataagaagaggaagagacaccagagctttccttctctaccatatgaggacacagagaaaagttgaccacctgcaagtcaggaagagggccgtcactaagaactgaatctgccagtaccttgatcttgtacttcctagtctatggaactgtgagaaataaatgtctgctgtttaagtcaaccaatctatgatttgttatagcaacccaaaaggacgtgtagaggaatattatgtcctatgaataccacagtagttttagtatacatggaatcagtttgtcaattgagattgtgttgaatttatagatcaatttaaggaaaattgacatctttgagttatcaagcctttcaacccatgaagatggagttgctctccatatatttagatcttctttaatttctctcagcatcgctttgtagttttcagtgtataggtcttatatcttttgtcagatttatacctaaatattacatatttttgatgctatggtaaatggaaaaggtttttattcaatgttaaactgcttgttgctagcatgtagaaacacattttttaaatattgctctcataaattgcaaccctgctaagcttattagccctagaagcttttgcacagaatatgtagatcttctacatagttatgttttacttcttcctttcttatatgaatgcctttcttttttctgcctttttttagtgtcttatattgccttatcacaatggctagagctccccatacaatgctgaatagcagcggtgtgaggagacatccttgccttgttcctaatctcaggggtaaagctttcggtctttccccattgggtataatgttagctgcaggttgtttttaaaaaatacataaaatgtgcctattattccaagtttgctgagaagttttatattttccttaatcaggtattgatgttggattttgtcaaatgcttttatgcatctattgatatgattatatgtattttcttatttgtcctgttgatatggtgaattatatgggttgacctttgaatgttaaaccatcattatattcctagaataaactctattgtgtcaaaatatgctatctttttaatatattgttggatatgattaaaattttaagattttttatatatattgattagggctgctgacctaaagctttctttttttaaatgtcttttctgatgttgatagtagagcaatgttgatctcataggatacgtcaggaagtgttccctcatcttcaactttctgtgagagtttgtgtagtattggtattattttctcttaaaatgtctggtggaattcatcagtgaagacatctggtcctggagtgattattgattattagtttgttttttgtgggggaaggtttttaattataaatttaatttttataatagatatagggctatttgtattttttgagcaaggtttggtagttcaagttttttaactaatttgtccagttcatctaatttgtcaaatttaggggaacagagctattcataatattttcttattatccttttaacatatgtaatctgttaaaatgtcatttctctcagtactaatttttgtaatttgtgtctttattttttttcatgatcagttggctagaaatttaccaatcacattgatcttctcaaacagcagcttttgatttcattggtttttctctgtcattttgttttttatttaattcatttccactttgatattcagtatttattttcttctgctcattttgtgtttcatttactcttctttttctggtttcttaaagtggcagctaggtcattacttgatacatttcctcttttctaatataaatatttagtattacaagtgttcctctaagtacttctttagctgcaatccacagatgttggaatattgttttaattttaatcaactgtacatactttctaatttctcttttaatttcttctttgactcatgggttatttagaagtgtgtaatttagtttccaaatatttgaggattttccaagcatctttctgtcatggattttttatgtttatttttgtttttagagacagggtatctctacaatgcccaaggtagactacaactcctggactcaagtgactgttccacctcagccttccaagtagctgggactacaggtgtgtgccactgcacctgctatggatttctaatttaacttcattgtgataggacaatatacttagtatgacttaaatccttttaaatctattgagacatgttttatggtccatggtgttgtttgtcttggtaaatgttccatgtgcacttgaaaaacatttgtactctgctgttagtgagtagagggttctataaatatcaagtcaagtggttgatagttttattctatatccttactggtttttctctacttgttctattaatcattcagagaatggtgttgaaatctctatcattgtggatttgtgtatttattcttgtagttctatagtttttgcttcatatgttttgaatctttgttattaggcataaaagtctaggataattgtctccttttgatgaatgaatccttttatcatagtgaaaccttctttattcttggtaatatcattttctctggaatctacttttatagccgttccgattttcttgtattagtgttagtatggtatatactgtgacattcttctaacttttttgtgtctttacattaaaaggggattatctgtatcagcctatagtttggtgttgatttttaaaatccaatctgggctgagcgcagtggctcacgcctgtaatcccagcactttgggaggctgaggagggcggattacgaggtcaggagatcaagaccatcctgcctaacgcggtgaaaccccgtcactactaaaaatacaaaaaattagctgggcatggtggcgggtgcctgtagttccagctactcgggaggctgaggcaggagaatggcgtcaacccaggaggtggagcttgcagtgagctgagatcacaccactgcactccagcctggacgacagagcgagactccatctcaaaaaaaaaaaaaaaatccaatctgatagttgttaatttttaattggtatatttagaccatttactttttttttttttttttttaattgagatggagtctcgctctgtcgcccaggttggagtgcagtggcgcaatctcggctcactgcaagctccgccttctgggttcacaccattctcctgcctcagcctccagagtagctgggactacaggcatgtgccaccacacctgggtaatttttgtatttttactagagatggagtttcaccatattggccaggctgatcttgaactcctgacctagtgatctgcctgccttggcctcccaaagtgctgggattacaggcatgagccactgtgcctggctgaccatttacatttaacataaatattgatattgctgggtttgaacatacatcttgtttgttttatattgttggcttattaattataagtcctttatagtggttgcttatagtgtgcacatttaacttatcccagtctactgttcaaaaataacattgtagtttatgtatgtaacaagctcttaaaatagtatattttcatttttctcctttggctatgtgttatttttgtcacactattatctttacataaattgtagaccctacaatacatcgttataaattttgctttaaataatcagttatctttttccctttcatttttagttgatacataataattgtacatatttatgggacacagagtgatattttcatagatgcatacaatgtgtagtgatcaaatcagagtaattaggattacaaacatttattttttttgtgctgggaacatttgaaattctctcttctagatttataatatatacaataagttattgtcaactatttttctccacagtgccatagaacactagaacttattcttttctagctgtaattttatatctattaataaaactctgtcttctcctccctgctacatttcccagcctctagtaaccataattctactctttccttctacttctgtgagcttttttgttgttgtttccacatgtgagtaagaacatgtgttacctttctgtgcctgagttatttcacttaacataatggccttcaggttcatccacgttgccatggatttttcattttttattgataaatagtattttattatacttgtgtgtgtgtgtctgtgtgtatgtatcaatcacatttgctttatccacttatctgtggatggacatttagatgaattacgtatcttagctattgtgaatagtgcttcaataaacataggtgtgcaggtatctctttgatatattgatttactttcttttgaatgaatacctattaatgggatttctggattatatggtagttctatttttagttttttgagagatgtccatactgttttctataatggccatactaatttacatcccaccaacagtgtgtaggagttctcctttctccacatccttgccagcatttttttttttttttggtctttttgataatatccattctaactggggcgagatgatatctcatgtagttttaatttgcatttccctgatgattagtgatgtggagcatcactaaaacaaatttgatgtttaaacttgttgggcatttgtatgtcttcttttggaaaatgtttacttagattctttgcccatttacaaatgggattattttttatttgctatcaaattgttggagctccttatatattctggatattagttccttcttggatgaatagcttgcaaatattttcttccgtcctacaggttatctctttactatgttgattgtttcttttgttgttaatagtcaattatcttttaaaggtatttcaaaaataggaaaaacatctggtatatttatcatttccagtgctctccattcgtttccatccatatttccatttagtatcactttctttctgtctgaaggtcttccttttatattcctttttttaaaattaaacagcacgccctgttcataccattcctttagatttcttataatgtagttctgttggaagtaaacccattcagcatttatatatctaaaaaagtttttatgcctcaatgagtattttttttttttttttgaggtggagtctcactctgtttcccaggctggagtgcagtggcacgatctcagctcactgcaacctccgcctcccgggttcaagtgattctcctgcctcagccttccgagtagctgggactataggcacacgccaccacaaccggctaggttttcttttgtatgatagagacagggtttcatcatgttcgttaggctggtcttgaactccttacctcaaatgatccatttgcctcggcttcccaaactgccaccgtgcctggcctgaatgagtctttattttatcttttttaaaaagacattttactaaatattaacgtctatgttgacaggagttttttctttttctatgctttagatatcccttcactgtttttggcttgcatttttcatggagaagtctgctgtcatttttatctttgttacgtaagatgtaatttctctctagctacgtttaattttgtctttatcacggtaaataatttgatgataatttgctttgttagtgttttcttcatattgcctgtgcttgtcgttcttgaatttcttggttctgtggatccatagttgtcatgaaatttgaacatttttctctgttgtttttccaaataaattttctgcccctccctgactttggggatgcatattaggttgtttacatgcatgcatattaggttgtttaaaattgtcttacagctcactgatgttctgatcatttaaaaaaattcttttccatcctcttctctgttttattttggatagtttctgttgttgtgttttcaagtttactatttttttctgtcttatctaatttgtttttagttccacctactgtatctttaaatgtcatatattgtattctcagttctagaattagatttttaaaaatctttcctgtttttatttaacatgcttaatctttcttctgtctacttggatgtacagaatatagttacaaagatttaatgcccttgtctactaattttctcatttctgtcctaagtatttgtattgattaatttttctccttgtaggttgtatttttttcttgtcttagtaagcattgtaattgttgactggatgagagacattgtgaaatttataatattgggtgctaaatatttttgaatccctatcaatatcttaacttttattctaggattcattggagttactggaaagtagtttgaccctttcaagccttgcttttaaggtttgttagacagtaccagagcagattttattctagggctaattttccccactactgggtttaataccttttgagtactctccctgatgacccgtaaattatgaggtttttccattctggctaattggaacataaactttccccagtcatgtttgaatgccagatattattcctctcaggtagttttatcatatgcatgtgctgatcagtactaagctgaaaatacaaggggatactgcctgtaaatcttgtagctcttctgtatatcctttcaatattctgccagtgaactacagctgtcatggcatttctgggtgccatactccatttcctcaactttaaaagaatgtctggatctacctccgttcctcctccctacactgtcatgtggaaaatgtctccgggcagcaagatggggcaatcctagggctgattttatttgctgcttttctctcagggatcactgttctgtactgcctaatgtcctatgtcttgtaaatcttgagtcatatatgttgtcttatatttttagatgcttcagactggagtgtatatctggttcctgttattctatcttgtccagcagtggaagtccttttaccatatttatactctactgtgagtcataatgatctatattaataatatccattagtacttatgatgttaatggtaaatgttctttggtgtggtaatgccatatgatttgctatagactatcatcattacagagatgcaggctgtatccacatcggtctatacagacttcaaccgacttggttgaagtggctggtcaatttaaactcttgcctaattctatcaaaaactaattttcgtgttcttcaaatcaattaatcattccataaattaactaaattgagcagatttctgagtatacgtgtagtctagttatattatttatgccaagggatagttctggaaactgcatatttccattccagtaggttgattccatgtgtttgctattgtgaatagtgctgtggcaaacataggtatgcatgtgtctttataatagaatgatttatattcctttgggtatatacccaataatgggattgctgagtcaactggtatttctgtctttaagtctttgaagaatctccacactgtcttccacaatgactgaactgaaagagcaaattttaattgttactgtatgctttctttactgcctgaaatttttgtttgtgtattttacataaataaataaatagaatcacacagatattgtatttttttccattaatccaaatatgaatctaaataagtcacacttatttcttcttgggtgttaattgccttttttgacaaccattcatccaatcagtgtgtttattctgaattgactcaattcaagtaaaacactcagcatgtgatttcctttttctttgtaagtcccctgtcaacactgatggatgtcattgtgaaaaggcatctcatggtggttttgttggttcacagatctgtctgtttttttttccccaatacaaatttgagtctgccatcatatactttagtttcatctttgttgtaatctagattataattgttttatttcatatttatttccccttctgctagactatcatactgatcttgtatgggagagggtgtgtcagtactgttgcttcctgctttagatccacaaattgaagtgccatccaccagctgttacattctctgaacaggcagcttgccaacaaaccagagattttctgatatactgcaggctttgtcaattattttaatatacttagatatagaaatattttcatggtacagagtatgtattagctgttttccttgcatcaataaacagctattatagttcaattataagtgtatgtgtatgtgtatgtgcatgggtatatatgtctcatgctcagtgtcttctggctttaatttgttgcctggaattaaaaattatgaactctgaggagcagtggcttttttgtgttagtgttgttttctaaaacacttaagttctggttgtagtttatgcaatttttagttgctttgaaaatatgacacagaaagtgttctggaataaaatgtacccaagagaattgtatttatcccattcatttgctgctcatccttaattcttgccttttcatgatctttataaacacattgctctaaatattctagcttgggttttcttagattaagcattttatgccagtggtggtaaaactgaaaaggaaggttcacatcataggggaaatgtatgtgtgtacgtatgtatgtctgtgtctgtgtgtgtgtgagtgtgtttgtgtatgtctgtggggttttgctacaaaggttaaatcccagaaatgttatgatagtttatagaaaatgtgtctcagttacagctgagttaaataagaaccctgaggtaatgctctaagaaaaatgaacacttgatgcccttttctttagtgtccccttagagttgcctaataggatcttagtgaactaacaatcataaacagaccaatagaaagaaaccttcttccttagaggaaaaacagtttcagagtcttggggtattcagtttgctcatgttgttagaatagtttcttttgccaaacactgaacattggggctgtgttttcttgttcaagaaggaggaagaggctatatgctaatgacagaaggcagctacttgcatgggtaatagactcaaaggaatgtaaatggctttcataaggcaaaatatctcgtgtataaacacttcaaaatctagaactcatatttcattaacaaagatattatttccttgtcttatttaaaactcacaagatattttaaaaattatgtttgatattgggatattaaagaaattcttttattttggaattttctcaagatgagacaaatgtagaattatgcatttgtttaaataccaatggaaataaaaaaatcacttctaaggggtccataaacaatgcttattgacttactggctcattgtacccccaaacactgacattgccatgtcactggatgatttttcattaattaaggaaaaagccaagtactttatttacaaaaaattgttaattttgacattaccttaatgtctttttacagatgtaaggcattttacacatccccctgccctcaattatttggttggctttattttaaataaaaatcaagggatggtattttttttaaaaagcccaaagtatataaatgtgaaactcttcagtaaatgatcagaacttaatatccagtttgctattgaaacattacaaatcactaactataaaggttgaaatagaattgcagcatcagaaataatattttagctttagaaatacaaaccagaaatacaaagcagaaattttgttgcctgtaaaatcagtactacatccttttatggaatagaagatttctttttcacagagtattctctggagccaaatacctgggttgtcaaaaatgctgcaaaatgagaatttagtttacagtagttgcaattgggcagtgtaccctaattgacttggaactagaaatctattaaaaggaagcctattaaccagatctcaaaaattcctgtagataaagctctagcaaatatgagcttacaatcaaaattcataaaacatgcaagagcccaagataccctaaataatataactattggaaaaatcagatatagaataaaaatttatatgtttaatatgataaaaaataattaggggagttgaaaataaaagtaagtaaattagaataaccagttaaattggacaaacataaacagaactataataaattgaaagtataataattgaaactgtagatcagaccgtggaatgaaaacatgagtgaattagggaaatatagatgtgaggaaattcccaataaggcagaagagaaagatagagacacaacacatgaaagagagattaaggtacattaaatatagatttagaatatatatctagtcagagttccagaatgagataataagagaatagggtagaggtagtatttgaaaacataaaggctaagaattttccagatatgattaaggaagcacatgtatacaaagcaagagaagtcaagagaaatctaatggggcaggtgcggttgctcatggctgtaatcccagcactttggaaggctgaggtcggcagatcacttgagtccagaagttcgggaccagcttgggtgacatggggaaaccccatctgtacaacaaataccaaaagtagctgggcatgctgacacgggtgcctgtagtcccagctacccaggaggcggaggttgcagtgaacagagatcatgtcattgcactccagccggggtgacaaagtgagacccccatctccaaaaaaaaaataataatatattgaaaccctgaaaaaccttagtggaactgcacatcaccaaaggcagagaagatttctaaaatagctagagaagaaagacatgacctaacaataatgagactgacagctggcttcacaatagaacagaaaccagtgtgacagctatctttaaagttaatattattttaggaagaaaaagcagagcagagaagcacaaaatgcaacactagaaatgaatccaaatacagtatctatcagtaattacaataaatttatatggactgaagtcactaattaaagaaaaaagattgttagaataaaggcatatttaaaacgtacagaatatttaaagttgaaaaaagaaaaaaaatatatattccaggcaattatcaactgaagaaaggtaagatagctatgattgtgtcataaaaaataaaatttaaagtaagcatattactagagttaaataattctaaacttacatgtatctaatatgaagttcaaatatagaaaagcaaaaattcacaaatccaagaccatgttgagacttttgaagactctgtaacagtaatttatgtactaagctaaaaataattttagtaagaagatttgaaggaaaacttgagtgatcggttagcatttaaagcaacttgacaatactacagaggtggttatttagtaggaagacttaaccaaaaagccccttttcggctgctatgagactttaaatatgtttatgtctgactattatggaagggtttgttaatggaaattaggaataattttcttctttagtgaaataagttcaaaatatgtgtgttggttagaaatatcctataggcatctccagtctgaaacaaagaggatttaagaatctacgggagtccagtaggctattggaggactttgtcctactctgtgctcagccatgttcaggtactctgtcacttgaactcattagaagattagctaaatactgctgctagaatggagtcgtatctgcttagattattttatgtaagattcttgtcagaatatctaaatgtgcagaaagctgggacttcattggtctttcatcatggcctatgtgactggttttttgcttgcttacaaattcatatttgtacctatggttaaattcagtctcagatcttgtatttctatcataccatgcataattatagttttattggagtggagatctaagtatgagctctaaatattttgtgcaaaaaagtaataattgtgaagaatctattacatataggtagtttacagcactatggtttcaattcattgactagaggtcagaatccaaaataacttgagccattactgtggaattttattttctgattttatctaataaaaaaagagacttttgtcaaaacaacagtaacttgaattattcctgtggatcataactggacaatttggactgatggaaaatgagaatatttattaaaaatgtcaaaataggacaagatcttagaggatactttcttttatataatcatgaggacctgtttgacaaaaatttgctcctctctgacctatcttatgggaagtactccaacaatggataagatgtacttattcttcatcaaagtaaccttttatttgcataaaatagcagtaaataggatagcagtaaaagttctgtaggtttctttttgaagtatgcactacttaaaattatttaaatatcaccttttacctatggaaaaggcaaatatgtatttccttttacatatggaaaaggtcctggcttagacgtgttctgattttatattcttgtaagtcaagatggagagttgggtagagaataagggaacctggtacaaagaatgatgtgtgaaagaagatttttagaactagaacagtgctagattgtatcaatattgtaagctatttatatacagaaactgtttgagacagctatttagtctccttcttttgaacttctgcaacttttcccccttagcattgtgtggttagctatcttgcccttatcttttcaactaaacagatgttacattcctcaaggataggaagacattgtctttggctttcttatgtgcccatccttgccagcccattactttgcagatagtaaatacctagtaaatatttgttaagtgactaattccctgaaactcaccatctttgtcatgtctcagtaagtcattctgtaaatacttcagcatatcacatattaatcattgacatttcagaagcaaagagagagttctgatgatcccaaaattaagtttcatttctttgtaggaagggctcagccttcttcaattttgtgtcccctaacaccttacaaagagcctttcttggaatgggcttttaatatgaagctgttgattgcaaatgtgggttctgttatcatgagaaactgtattgcatccttgcagatagttttatagtcctaatggtctacaggccttttttagccaccatatttttaaacaatccttttattcagatctagtgatattactctagtggcaatgaaaaaaaaaacatggtaagaaagtatagccctgtttctactggatgtagatttaattttcatttaaagtctttcttaccctgctctattttctctatttttgttttctcttggggtttcatctgttcatctgtgggtctgtatttatttatttggcaggtataatctttcctttcctctccctccccctggcatctccttggaagctgctcttactttgtgtcaccctaaagctgatggtgactctgttttctggcttcaaaagcagttttatgcacttttttctctctctctctcccactctctatcttttttgaaatgagctgtctttgattatagtttgacagtgtggtctgactgctaacattgattcccagcagtgaacaactttgtcatattgttcaacattaggtttcgatgtgtcatttaatagactaaaaagccattcccagtaaaatcgaattcctgtgggaatcattgttaaggacgctctcaaaatgaagtaaatatgtaatgctttagaaatttcactggaaaggcatcaggtgactacatttactgaaactaccaatgtcttagctggattttatattctggaaatgcaatttacaacttgcttgcctttatttaggcaaaatgtgattcacaataattaagctttatgagcttcttcacttaggcaggtcaaataatatttttattttgtttttaactgtaagaaaatacttgctctttcttcacatttctatatgtgaacctaactaaattcaggtctgggcccagaagtgcctgtcccatttcaggctagacatgcagtatcactaaaaactaatatttaactgtatgctatagtggtggaaagagcaggccctgaaaccagactgtatgggttcaaatgccacctttggcatttactgactttgtgacttttagtgttatgtaacttatctgtgccttagtattgtatctataaaatggggatagtgcctcctttataggattgttggataagagttaatacacttgtaaaatctgtgcacacttagtgtgcatgaatcatattaagatttcagtattatttgtcatgcttattatgctgttttgtttttttgtagttgacaatgtccaatatttatttagagatattcctctgtcttatatctgagaaggatgcagaagtagaaccaaaggctatcctcttcattgacccagcagtttgtttctcacaccaactttgcataacactcgctaacagaatgaaagcacttcagtagaccacaccaactttccttgggtggcagtgtggaggccccttgtgattacttaagtatgctcccgagagtctgatttccctttgccatcaattcctttttgagataagactagaaatgttttccacatgtctttaaattttcagcgaacatgtttttcttacctggataggccatattattactgaggttcaactgccaggatctcagtccctgcttcagaggagtataaacatgggtggacccaaagagaagccaagtgggtagcgcccactaagcatttgggcatctatattggttcattagccatagagatggcatttagataactattagttgaataacatcttactctttgtgtggaatcgttttataggcactggctatttcagatcaagtaaagtttacctctagagagaagcttggttgattccagagaagaagtctttatttgcctcagattcttaccctggcaatgaactatttttagggctgtttgtagtatgtgccttagacctaggccttgagtcagtcaaagtaaccctgtctatcacttctgtgtcttggctaaactactacatatagagccttcactcctgctgcaactcttgcccatgtcaagcacatctagagcttagtcctgctggtacctgacatgaattttgaacctgtttttgtctcctgttttgtcttactttgccgtgggctgtctttgcctgggcttgctctacgctcttcttctaaggtctgttttggcttttttttttttttttttccaaacgtatcccctagtgccatgccaggtaagtgataggtcctcagtaaatgtttatagaacagaaatgctggatccccctgcaatggaagcttgtctaatttgctgtgaccttgcattcagctttgacttctgtgatggtatccctacaactgtacttctcaatgctcagtaagctcttactaagtgccaggcactgtgtatatcactttgtattcagaatatcattttatcctctcatgaaaccctatgttattggtattttattattattattattattccctttgtacaggtgaggcaaccgagacccagagagattaagtaactcacccagagtcatccaggccaagtaaccatcgatgatgggattgaaatccatgtctatctgaatgcagagacagatcataacctctactgggttgccttgtatatcataccatttagaaaatagcatgacactttgagtcagctgtcccataggcagagtttatatttcatctggttgggccaaatctccaccttatcctaaccaggttttgtgggctgctttagctgcacttgctcagatggctataaacgtgaggcttagtgtccttaattgctgctcgggttggagagcgcattgatacaagaatgctcaaagactaagccactgtttgtgggatggaaactccaactgctgaactgaatcagatctgccagcatctttagaagaaacatgaaagtatagcagagctgtagctcttcccatatctccaaagcattcacccgtcctgtgtaggtagacatgaaagtttttatttgcaagtaccttctactctttcttgagggctttctctggctcctgaagccaactcagcttggagggagagagggagtagatcagaagtgttggggagttgaaacccaggagatgtccatcaatgattggcaagagtttgtagattaataccctagcttagtttctatcaaactgtagcatgcttaagaatcttgaaaagttgtttaaaaattagtaggttggaggtgaggcccagagtttgcatttcttttttttttttttttttgacttttattttagattcagggagtacacgtgtaagtctattacatgggtaaattgtgtgtcactggggtttgttgtacaaatgatcctgtcacccaggtagtgagcatagtaccctgcagttagtttttaaatcctcactccacttccaccctcccacttctagtaggccccagtgtctgttcttgtctttctatgtgtactcaatgtttagctcccactcatcagtgacaacatgcagtatttagttttctgttcctgtgttaatgcgtttaggatgatggcctttagctgcagcatgtcaactgcatgttgctgcagtggacatgatttcattgtttttttgtggctgtgtactcagaatttgtacttctaataagcttccaaatgatgctaaccttcaaaccacattttgagtagcaaggccctgttgcctcccatttgggataaatatgcagtatagggtatgctgtaggttccttagcaggattgagctccagttgttgataaatgtaaactgtttaataataaacactttattatctcctttggttttctttctgacttccctacttttctatcaatgctctctggcatcagcatttacacaaactgctcaactacaaacactctcatgcttgtctcagtgtcttcttctggtagagaccaacctgagcagatgaccataccaacttctagaatggaaagccctacccagacagtgggactgtctccagtcctccagcctcaggattttggccgacttgaggtcactctcatggatcccttccagaaaagtatcactgggcatgaggtagtccaggttgagagagtgtattgatcttaaagtgtttgctgatgacagcatagctggcattcttccctgggggaattgccaggacccttatttgagaaaaaggtactgtgttctttctctagtgaccatagggcttctaaacttgatatgagccaagattgcccagtattctgggatagattttttttcttaagggttaaaaaaagagagattcaaatcttcaactctaagaaatctatcacacttttgaggatccattagggataagggttagggagtagttagtcaccggcatgctttcactctgaattcctgctcccagctgaattcccttaatgttttctctctaccagctcctaaagttttctctggttctcattaaccccgaatttaaacatggctcctcctgcttcacttcccacagcattactcccataatgctgttgggtatgttagacccttcctgaaggtctgaggttaaaggatggaggttacctagagaacacttaaaattcagtctaagatactaaatactatcactgtgctactaagaattagtatcacagtcactaagttttggcatccatttctgttgccaagcttcccatactggtggctgctgctcatatgagccccaagacctgttatattttctcatcttgttttatttttcttctcagttcaagctgccccctaccagcacctccctgtgtgtctgcacaggctgtagactgtgcaactatggggggcactatttaccatagactgcgatgaaaatagcatcccctagagtttatgcagcttgatagctctctgttctcaaccccaaaagacttagacaccactctcttaaaaccagtggaagacggaattttctattattttattatacacagcaattaaacatcattttctttcaatctgtattttctagaagtgccccaagaatcccacatcagcataaccaaaagtgtcattaatgtattttttccccaaaacaaaatagcagttttctttctgtgaagaattctgtcttccttttaagctcaaattgcatccagcttctaaaattgcaatttctctgcccgcactttctgtttagcccagtgaaggatgacacaggttctatctaggccttaatcaaacaaatcactgtgaggacttctgtcttagctgtgaccctgggccctttgggaattcccgtcccccctaggcccttctggagccagctttttatcttgatatttctctgctttcaacgcaggcttagaaaacctttcaattaaagatgtcatgttggccttaatggaagccgctcttcatacctctcattcccccaaataggctgttttccattggcagtgattcataggagccacagaagagtttgagatttaagtcattctcaaccagttacagaccctaggagcagttacagacgttaggtgacagagttgaatttcagaatccatagcctacactcatgctagtaatggtgagaagtgtaaacatagggataagagacaaggcagtgatctcagaggaacctaaatatagttaccatccctgtaacctttgcataattgttttttcagccttcttctctgtaaaatggggatgataatccctacgttacaggcctgttaaaaagattaaacaaacgaatgtctgtaaagttcttagcatggggtctgacaataataagatatcacaaaaaaactattgtcatcaaacctctaagtctgtgcctctgagggatgtggtatcctgatataggttggtagtcttcctaagtaagttgaatctcaggcagcagaggaaaagtccagtgaaggagaacttgaagattctaaatggatgtgcatagcacaccccttttggcagaacagtgactcaagactgtaataagcagaaattaagggaacatcttcctctggagctcctaggagacttgaaaccagtggcagagtctcaggccctgtgggatgttacattaccacaaatctagccatagcctactattaccacttttggtaggagccagctatactattattattatgaggaaactaaagctattaaagggttgagctggtattggaacccaaataatccaactttagaacctgtgctctttaccactgtttttttttttgtctccttaaatatgtacgtgcgtgtgtacctattatgcacataaatataaaattatatatctattaatatatagtatatatgttaatatagaatatcatatataaagttgcaaattgccttaaatatatttccctgtaaaactgatatttataagtttagaacatatttttttcttgcatttgaacaatgttcatgtatactttggtctcacaaatgaaacctgtttgtcattgtgcttcctaaacttgaatattttatggaccctgttgaaagacattctctgggacccttagtattgacataaataattttttgttgtaatgttactctaaaatgtagaaatatataatcaggtataagtgtattatgcttgtggctcctaaaattatttaaaaacaaattttgaaactacaaaagcaatggcattcaaattaatgacacaagtttcatgtggcaatgatgtttgctggaacgaaattgctacttgagaaatcaatatggtgtagagttacacaaaacaggatctttagagttcagcatgacagaagtaccatgtaccatgtgatgaaaacttttgctgctttttttttcctgctttttttttcctgttgaaattgctatgaaaccattcacaggatgggcagaaacagcctttgctcttggtgtgaatgcaacatttatatactcagtgtctacctttgttcctccaaaataatggtacttggtacaaattgattataaatgtgacttttcagtatttgatcagaacgggggataataagggagtcatgcagatgacactaaccagcatttcttctgctatctgcattctgtccctaagggatgtcatctggtgtcctggctttaaaaaacattcatttgctgacaactctctaatttatatctatggcgtgtattgctcccctgaacttcagatttgtgtatctaactgcctaatagacatctcggcttagatttctaaatcttacagtttacaagtcccaaacaaatcttctggccccctgacctgctccaaacctgcttgtcctgtattcgtctccatttcccagaaaggcaactccactcttcctgtcgtacaagccccaaaccgtagtcgctctttacttttctctttttctcacatcttaaatccagtcaccctgaaaatcctgttggcctaaaaatatatccagaacctgaatacttctgcctgcctccattgctggcccccactcccaaggcaccatcatttcttgcctggatgatggcagtaacctcctcatttgtctccttgttttcaccctggcattcccaattatgtagtgcaaatacagtattttacatagcaatcagagtgatgctttaaaagtaaaacacctaataggttactacagcattcacagtcttcaaccctctaaagggcccatttcagagtaaaaaccaaaacccttaccatgtccgtcaaggccctgccactgttctttagtcagttgattccagccttacttttcttcaaacaacacacaagcctcgactttgtgtaggctttgcactgcttttccctctgctgggaatcctgtttcctcagatggtcacctggcttgcacctcctggcctctgcttagatgtcactttatcagtgaggccttccctgacaatcctatttaaaaaactctgttcccaacatacttcttcctcatcactttctcacctgctttatgtttttttttttttcccatggtgtgcctatcaccatgtattagtatacacatataaatgtatatgtatttcaattgtttattacctgtctctttctactagggaatatataagttccatgaatgcagaaacttagttttttcagtatctaaaatagtgcttgtcacttattatatgtgtaataaacatttgttgaaggaatcaatgaatgcttagtttttaaaacttgtcagcagaataaaaacacgaaaggaagtattattagggagaggttgcaaatctgagggtaaaaattttataccagcgtgtaacaccaaggaatgtactatgagtacaacttagattttgtaaaatgttagaaatctttttactgccaactttcatttttatcaatctaacatcttttgaattttacagttgaacataacttctaatttctcctaaatatttgcatgtatatttacagcttatttaaaaggtaaccacggccaattgtgtgaccaccaacaccatgctggggtgttaatatagttcagattgtctgagagaaaagttctttgtaaatcagtcactcccctgattttcacttggaattcatccaattattgacagcacttagtttgtaacatttcctggactcagaagagagggaagcttgctgagctgaaaccctgatatgcagtggagatttacattcagggggaaacagtgtctgttgaactgtgttaacagctatccatgtaggaaactcgaacagtatccaaagagcacacataattgtggtgattaagccgataagctggtgacacaaggaaagaaagtacaaattgaagtttcagcaacaggtgtaaggcacgtggtctatcctttcctggtagtcttaggaaagtaataagatagcttaattacatgattaaaatactcaaagtccagctgcaacccatagtttctgcctgtgcttgcttgcttgcttttttcttattagaagtgttgagatctttagattgttatggtttacctttctgttgtcctctatttttttttttttttaagactgagtctcgctctgttgccagactggagtgcagtggcgcgatctcagctcactgcaacctccgactccctgcttcaagtgattctcctgcctcagcctcctgagtagctgggattacaggcacacaccaccacgcccagctaatttttgtatttttagtagagatggggcttcaccatgttggccaggatggtctcaatctcctgaccttgtgatctgccctccttggtcccccaaagtgctgggattacaggcgtgagccaccgcacccatcctctgttggcctctatttttttagcttttatattaaaatactgttaatataaaattaatccaagcttgtcttcacattctgctgttttttccccccagtgtaaattaatgacttactcaaaacaatttttaagtcattagctaaaacgtgtacacatcttaataatatataacaaatagtgtgttcatgaatacacagtgtcttatatacacttattatcatgtatgcgatatatttgtttgtacttcaagaacattatgaaaataagggatgaaaccatgatttgatttgcatgcataagaaaaaagagtctctttgtttaaacagaaaattgagtcgtattgaagccatacttcagcattgtaggaagcatcctgttataagcacgtctttcttttccttcctccctttcttccttcatgtttcaatagatattgattgagtacccactatgtgccaggcaataaagtacacactcagtttggcattggtatgaatgctaatttagcaatcctaggctatcctggagtggcatcttgaaagtactcagttggagtgagcttgcatttagtttttcagttgggcatgggaaagatgaggcccatttccctggatttggaatctggtggttttgcatttgccagggcaaggtgctgtgtttattctctaaaagagtctcacttacctgttagtttggcttcaaaaacttttagcaacctgaactttaattttctgttatgtgaacacacagacaccacacacacacgctatctatctatatatctatctattatctatctatctatctatcatctatctatctatctatctatctatctatctatctatctatctctgcaaggtcttatggcttatttttcttcctaagttctagacttgttttattttatcttcttattcttcctctgagttccctgttttagttaaaagtttgcattatatattgtagcaaattgtttttgaggaaatgtactatatttattcaatacaaaaagataaatgcgtacatgtctagaggactgagaagatagatactttgaaaactgccctaagattgaatgtaataggaagatgaaatgttcttaaaagaaattaaatagattaactaacttatttcccacagaccattagccagacagaaaatgataggaaagtcaatgcttacctgatcacctatttcaatatctagagggaggccagaggtttcacatctcattaccagtctttcctaatattatttctttatatcctttactttttcattggttactcataggggagatggctacctgagagagctctctatttgaaaatgtgtttatttcaataagaacaaaattatctggacatttttgtgtaggatattagacaaaatatttttatgaaagaccttgaagtctgaactttgtgtaggttttccacagtacagaaagaaggtggagtttttggctgaagctgacctgcatttaagttgagattgagtgctgtattacttctgttttgaatccttcttcaagacttgtccatcatagtcaatcccaaagctcagagtttctgaaaaggattttaggctgttaaaaaatacattgtatggtaacacttaacagtttttaagaaaaatgatacatgtgagatatgatggattttagaaattataataacaccctctggttagtgttcctttactacttctgttataaatcaggagtttgcaattttgacagctaatctttttttctgtcagcgaaaacttgagtcagcctcttaactataagctaactgaaaatgaagactctgtctcttaagatattgatatatattttccttggaattatagttcgagcctctgaatttttgtgtcttttgggctgtcataccctgtgatgaacagaataggactttgttcctttacagctggattaaagatataacttcagatacttatttaaaaattagtattgtttccataataagcaaaatagtattgttaattcatagcacaggcattatttcaaaacaaactaatgatgaaactaagatttttaacataaatctgcagtatggtatgtgttctactgtccttattccagctgttgaggatttgaagtgagaacgggccaattttagcatgtgttggaaccatccatttgtctatttgacaaagatcttagaatcttccagttgaaaaggtctttggagaccatctacttcaactcccttaatttacagttgaagggatccgtggagaaagttactccccaactactatgttaataagtacaacattgttactcagttcattgccaggcaaacctttgttaggaatttaacagttccacaaatagccaacaaatagttggcaaactttatattcttatttgtaggcagctcatcatattcaggaaataattttccccaggagtgctctgactttaacacatggaacttgttttcactgagagaacaactgaaattctttcagaagagatgttttagaatctctgttataataaaacacagtataatgttacatgcactagaatgtagtgaggtccaactttcattttgattccattatttatttgaacgctcccttcctcctcttctcttgttttgtttctttgtctccatgtttccaaaaggagttcttatcttggacaacctatttcatctttaaaatagaagtaatattgtcacgtcttcctagatctggggggctaaacccagaaattctcgtgactttcttactactcaagacagtcttaggattttttttgttttgttttttgttttttgagatggagtttcgctcttgttgcccaggctggagtgcaatggcgggatctcggctcaccgcaaccttcgcctcctgggttcaagtgattctcctggcttagcctcctaagtagctgggattacaggcatgggccaccatgcccggctaattttgtatttttagtagagaaggggtttctccgtgttggttaggctggtcttgaactcctgacctcaggtgatccgcctgcctcagcctcccaaattgctgggattacaggcgtgatccactatgcccagctaggatctttatatatttttgaatatatttattaggtatcttctaaagttgtttaaagttgcttcaaatttaattatcagattgatttctggaaacattgtctttctacctcctcagactgctggggaattgacaggaaaatttggaatcaaacacctagttattagggaatatatttcatttacttgcctggattaaccattcccctcctcccgctctagctgctatgtgtatttagacctacctttattgtaaaatattttaaaaatgtacttctatttttaaattataaaataaggcatattctctttataaaatttggaaaaatagaacaatttaaataaaatcaaatgtttataatcaggatctaaagatgatcttgctatatactggtgtttatatatttctagtattgcttctattatttcttttcatttggaattacattgatcatttctttttttctcttttgttccattgaatcaatatatcatgggcattttgtcatgtcattaaatatttttatgaaagttgacatagtgttacaaaaatgtatcatgtggataaatcacaatttaaccaatcactattgttagtcatttgtgttgtttccaaaatttgctattagaaataatgttataatgcacattcttgtgtgtatatctacgataattttcttagggtaaatacccaaatgtggaattagtcatatggtattttcatatgtaataccaaaaggtcctctagaaatttttatttcttaccatagggcccatttacctctgtcctaattatatatatatatatatgtttagagtttagagattcctcaaaaagttaaacatagaactaccataagacctagcaataccactcatatgagtagttttatgttcattatggtagttctatgtttaacttttttgaggaatctctaaactgtttttcatagcacctgtaccattttacattcccaccagcatagcacaagtgttccaatagctccacttgttccaatagtaacacttgttgtttcttattttattgatagtagacaccctaatcattataaagtgatatctaattgaaatttttatttgcatttcactgatagatagtgatgttgagcatctttgcaggtacttactggccattcgtgtatcttctctggaaaaatgtctattcaaatcctttccccatttttgaattgagctgtttgtttttcattgccattattgagttttaggagttcattatgtgtttcagatattaatcctgtgtaagatagatgatttgcaaatattttctcttattctggggtttttctttttaatctcttgaaaatgttctttttttgagaccaggtctctcattctgtcacctaggctggagttcagtggtgtgatcacagctcactgaagcctcaactcctaggctcaagcaatcctcccacctcagcctcccaactagctaggaatacaggtgtatgccaccatgcctggctaatttttaattttttgtgtagaggtgaggtttctatatgttgcccaggctggtctcgagctcctgggctcaagcaatcctcctgccttggcctcccaaagtgttgggattacaggcatgagctactatgcccagccttgaaagtgttctttgatacacaaaagttttacattctgatgaagtcaagtttatctaaatttatcaaaacacgcttggtaatggtgtataatcctttaaatatgttgctgaatttatattgctagtattttgtctaggatttttgcatcaatattcacaagaaatattgatttgtagttttcttttcttgtagcgtctttggttttgttatcagggcaatactggtcccataaaacgaggcagaaagtgttccttactcttcaattcctgagaagagtttgagaaggaatgaagttaattcttccttaaatgtttagtagaaatcaccagcagaaacctttggtcctatgcttttttgttgttgttgttggaagccttttgattattaattcagtctccttagtagttatgagtctatccagattttctgtcttcatttttcaattttagcagatagtgagttgctaggaatttgtttatttcatctagattactcagtttgttggcatacaaatgttcatagtattctattcatagtctttttcttttgttttgtaaaaccaacagcacttgcttttggtgcatccaataagtttttgtttgttgtgattttattttcatttgtcttaaagcattttctaatttattttgtcatttattatttgatctactggttaagactgcatagtttaatttccatatacttatgaattttcctattttccttctgttagtgattcctagtttcattccattgtgattggaattttttttgtatgatttcaatcttttaaaatttattgcaatttgttttgtggcttaacattattgtctgttctgtagaatgttctatgtatgcttgaaaaatgagtaatttattgttggatagagtattctgtatatgtgtgttaggtctaatttgtttacagttttgttcaaatttagtattttcttattgatgttctgtctgttgtacctgttattgaaggcaaggtattgagtcttcgactattatctcccttgtattccagtatgtagaactatttcttccttcaattctaggaatgtttgtttcacatattttggggttttgttgtttggcacataatttataattgttatatatttttgatgaattgacccttttatcagtatataatgtgtgtctttctccttttacagtttttgacttaaattctattttgtctaataatagtatagcaaccccaactatcttttggttacatttgcatgtaatgtcattttccacctatcagcctgtttccatctttcaatgtatttgtgtctttagatctaaatgaagcctcttttggatgacatatagttggatcatgtttcattttaatacttttgctaatttctgtgctttggagattttaatacatttacacttaaagtcactactgttaaggaaagatttacttctgccatttgttatttgttttcttatagcttttttgttgctaatttgctctattactgtcttatttttgttcaattgatttttttttgtagtgaaaagctttgattcctttattatttctttcgtttatattctacaggtattttttttgtggttactctcagggctatataacattctaaatttatggcaatgtaatttgcatggatactagttaaactttggtcacatacaaaactgcctctatataccttcatgttattggtatctttatacgctgtctacccaatgacataggtttataattgttatttatgcatttgtcttttaaataatgtggaaaataaaaaatagagtcacaaaccaaaattgcaatattacctgctttgtatctgcctatgtatttacctttacctgagacctttatctatttatatggcttgaagttactgtcaagcatcctttcatttgaacctgaaagactcgggttagcatttcttttagggctggtctagtggtaaaaaacagccttagcttttatcagccccgcccacacttttactgcctgagttctaaattagatgaaacaaagatgagtaccttgcttcagtccttcttgtatccctcaggcaggttagagcaaatgtacaaataatttgcaaataaagtctgttctgctgtgtttgctttgagggagggaatgggaactggaatgctctggtttcccgaccaagaccactgtcagaccagggagagggaggggcaagtatgaataaagacaccacaaaattttctattatttcgaagataggtttttttttgtttttgtttttgttttaattaggcaattgcttgtttgctgtaaacttttgagtttttttcacagctccataaaagtaggtttagacacttgctgcttgtgttttttgatgtttctgggggatgggggcaggcggtgggggtgtttaagaacttgatgcggcctggagcggtggctcacgcctgtaatcccagcactttgggaggccgaggggggcggatcacgaggtcaggagatcgagaccaccctgtctaacacggtgaaaccccggctttactaaaaatacaaaaaaattaaccgcgcatggtggcgggcccctgtagtcccagctactcgggaggctgaggcaggagaatggcttgaacccaggaggcggagcttgcgttgagctgagatcgcctcactgcactccagcctggacgacagagcgagactctgtctcaaaaaaaaaaaaaaaaaaagttgctttctagtccaccattttgctgacatcttaaattttttttttttttttttttttttgagacggagtttcgctcttttcgcccaggctggagtgcaatggcgggatctcggctcaccgcaaccttcgcctcctgggttcaagagattctcctggcccagcctcccgagtagctggcattacaggcatgtgccaccacacccggctaattttgtatttttagtagagacggggtttctccgtgttggtcaggctagtcttgaactctcgacctcaggtgatccgcccgcctcagcctcccagactgctgggattacaggcatgagccaccacgcccggccttaaagtattttttaatgtgtctaaatttttatattgtccctttaaggtatacttatgccctgcaaagtaattatacacaaaccaataagctaagaaagaatgaaaggagtaataatttttggtgctactttaactgtgaatttagagtaggaagctttttttgcaagtatattttttgtataaaattaagaaaatatataaaataattgtatcccccttttttaaatatttttacctcttactcttttcaggttctaaaatgtgacttaattatgaaggttattagcaagaagtggcatttccaaaagtttcagcactgataccactacaattacaactacaataccactgataccactgataatttgcttcttctttctctcctctgtccacatttttagagttgaagtatatttttagagttgaattttaatatttatttttggggaagtaattttgaagagtcagacatgaagggtgattgtcaaatttcttctttgtttacaatttaggttgattgttaatgacaatttgtgtactggactgctgtgatgcaatggagtctgagactgggttatggctcagctagaaagggtattgtgaccaatttatgatgtttgccatagtcctggaaggtggcagtatttatgtcaatcattttccatctttattttcagcatccctggagccccaatctaataaagtcctcaaatcacctatgtgctgctttaaattaccagctgttataaggtacttaatttgaatcatgtaaatctataataaattggggatgatttctctagtagatcattttagaggaactataatatttaatgaaagtccaagtaaagagcgtatttaaaatgtcaaaagaccataggtttatcacattgaattctttattcctttgcagtctagacatttaattcaccttgtttctgttcgggttccaaccatctttgaacacgcaaaacaatatgattcacacaactctttgacatactcagcctaaatttatacctaatgtttacctacgtaacagcagtatttcaacgccctctttttcatttactctttggtcaaagaaaatctctttcacccagtgttagcttaagtttttgatattgagcttcatgtctctgagtgtcatatctttaagtacatttcctgagttttcatttttaggcattatctactggcattccattatgaaaagataatttgtctcttctttctctcctctctccgcattaccccataatataccagactttctccaccctccagctttcttacataattatatcaaagtaatgctatacaaattatgatatagctctgttcagtgtttgcattactatacgtatgaaaagcgatcaagaactagacatataacagctacaatattttttccttttctgtgcagctcttatttaccttggagttaataatagcatttatagttatttgcttggttttctatgtacttgttaattcaaaccaaacatttaatctgttacctaaatctcttctcaggatacccagacaaatctggtattccatcatttttgtctttctgaagaggattttcctggaaatttctgacctcctgtcctgtgaacaaattatcctgtaggttttgtatcaactgtcatcatcctggcctgtcccctcaccgttaccctggggactcttcgcatctttcctctgtcctatctattgtttcctgtgtctcatcttcctgtcttagtttattcttttattttggtgacactcatccctctgtatctttcaaataaatgctactttgcaactaaatttttgaatgatcttgtatctgaaaatataccttttactttgttgatggtttcctgactaccgaattctagattgaaagtttttttcctcagtgttttgaaagaattgtttttgttttttctcctctggaagcttgtagtacactaggtaccgaaatttctctataatgtgctttgatgtgggtttatttctatccgttgtaataagctttctgtgagcactttcactcatgttctccctggggaattgtctaaattatatcattgattttaccactcctcttgtttatctttgtggaatttatacaatttgatgttggatctactggactggcctttctttcttacatttgatctctttgtatttgatattttctcgattctgtcaactttttattttttgttatattttttgtttccaagacttattttttttgttccccaaatattcctctttttttccttttagtaaaagtattttgtttttatgttatggttctcttctcttatctctctgatattaataatagatttttttaaagttttcttatttctgcatattgcatttccttcaagttgctattatacatattagtttgcttaatttttaatctttcatattagtgactttcctcagatgtcttgtagtcttttgcttatccactgacatgtaaaggtgtgggacaaagtagctcgattggagtttttgtgcataagtttgtccatatagttttgcagtatgatgatccatttgggctatttagttaggtaaacttcagagttatcatctccatatttttctacttaggcagatcagatatcccagagaaggatcctctagcctccttcctgtggagggagtacctagcatcttcagagcccccattagggaggaaaaatggggagattctggcatccattgtgcttacgttcacttaatctctctgttttcagtgtgttttccactgttaactatgcagagaccttttactttaccccttagcccttatttgaaaatgaagagggacatttaactgtataagatccagggatgcaatttggatatccacctgcttcttagatattttttcagcaaatcgttgttatttggctttattccttcacccttatctttgaagtacccataaccaccaattccttagtcttttagaatttagcagtataaatttggttggctcttacatcatggactcaattattcacccctcattcctctccaattaattaccttcttttatctttttttttaaacggtgaaacttttataataaattgattttattcgtcctctgtctttctttacttgtcatgcctcccagtctggtttcagcacccctcaactttcatttaagacacctctgtgttgataaatctagcagatatttttggcctttgaattatttgacatctgtgaagatttgccccagttaggtactttcgccttctagtttgtctacagcttctctggaagctctcagttttttctagttccatggtcttctactttcctcatgattctttcttttagagaatatcactcaagaccagtaatatcaatatatctaatatataatattagatcaatatatctagtatcaaatatatatgtatgatatataatatacatgtaacataatatataacatatctcactatattatatatgtgcatgtatctgtatacatacacaaacatgcatatgcaaatccacaaccatgacacatgccaaattgtcctgtcatgtagtttggtcacagacttttggaaaacttgctgtataatgaatgatttctcttttttaatgtgcaaaggtctggaaaacatccttagaaatatagctggtgtttcttttatttgctccatgtcaaatggcagagctggaagtgctcagttaaaccctgattccttgcagcttaattcttcagtctcagttttagagtaatgaaataccaagtggctgaattagcagattttggaatgctgtataatgttctctttataatggaaatgattgatggtattgtgtaaatgttctatgatatttggtaaaagttaataattctgttttcttatttgtaaccttatcataatttctaccatagtaatgagcagacttttagactggcaatttattgaaaatgttagtaaaataatgatatcatatgaggcagtttagtctataatctcaaatgtaatttagcagaaaatattaaatagccattttgtaaactgacagaactcaatttttaatgaattgaaatacagatggagagaaatgccaaaatggattaatagtgttataatagctgatccttttagaccagaccacactgtcttcaagatatatgcctattaaaatcttggtattctaattttaaatatgacagtagtgctattaacataaaaatatgactcgattaataagattcactttatgactatttaactctctcatagtcaggaagaatccctcagtctagtattcaagagaatcttcttaatttctagattttcgaatagaagtaggagattaaatcaaaatgccagttgttttatgaaatgaaaagaatgtctgttgttgccttttcagattaggcatattggtacttggtgttatcttcctgatattaattttatactactcctgtatttttactaagatgaatttggtttaaatgtgaaaataaattatttaaaaagagataaatcttttgcaatcaatgtcggcaatagagttgatttgcagcagtgttatctttgaaattaagtgatagtgccagtaagggttgcttagaatacttcttacagatacttatatgaattaatggaattgtacacttattacccgtgaagataaatatgatcattgaaatggtatgtgaaacattcaattcctaaattaactagaatgaataagaactttcattgagtgattttttattgtatagccgaatatactcctgagtctatagggagctttgcctttgagttgactcataaatattatgcttttcgatgaggtaatttggtcctccagtaactaaacccctgaaggggaagtctaatattgtcctgttcttgaacttccctctaaatttaggactgatacagtgaggggttaccttttaatatgcagtatttactgctttaaaaactaaattaactactcctcttggtctattgttaatgaattgagggttcagcttaaccttcacaaactgtttaaatgaagcacctgatgatatttaaactcactgtaatatttcatttaaaataaatcccagaggtacaggttctaaggttgtaagaaagccacggtgttcctatatatatgtatttatttcttttacactaggccagacctttataatttataaccaggatgatttctgtggcctttaaatgtccacagtgcttgataatttcttccttgttcatggtcctgttaggtaaaagttttacacttacaaaattagatacaaagcttattctcaagaagcatacagcctgataaccatattcagtatctccacaaggataaagaagtgatctaatggaaagagatcaagtaatgatcaaatacttcatatttagaagatcagagaaagcttcaaggagaaattgccttaaacatgtgttggaagttagtatagatgggctttggtccttttagtggactttacagtgctctgctcacctgagtccatttatagctgtggatggttcttggcatgcagatgttttcctaagtcaggcatcagcacctttttgcttttctgcctttgggctttctctggcactagaagagcttgcttggctatgctgcagtttccacaggggaatggagaggagttaacaccctcaagagcaaccctcagacagtggctgatgggaaagaatctatagatcaatggccctgcctccccagcctccttcaggagaaccatttggtggtgtgaccttcatgtttaccagagggtccctaacaggattgtgctcctgtggctcacagtagtaacttcatcattaatgcagccattattgcattttctttcttttctcgctttccattttcttatatttcttgagatcacttctgaattaaaccatctacttccaaatccttttctcagcatctacttttggtgtacccaaactaaaacggtttgttagcgttggagaaagaacagcatgaatcaagttgtgcagattaagtatagcatcagtgagtggttcagtttaactagactatcaggtttatggttccagggcaataaaattagtcaggtcacaaggaacttaaaagtcagtctaaggatttggggcttttcttcaggcattgcagactttccaaagacttagcagaaggaggtgacatgatcaggattttgcttccacatagtgacttgatggcagtctttaaaagagatcgaagatgagggagactgaaagtgtggagaacatctaggagacggttctgtcgtgctaggatctaggttaggcagtaacactagtgggaatggaaaggaaggatagtaaatgctacatttagcaatcggtttgatatggatgccacaggagagaaaggcattaaaaataatgcaatatttctagctttgactgctaactgggaggatggcaatgctttgttcaaaacagaaaacacagaggacgaacatatttaagtgagataaaacttttagtttacttctgtggcaaaatctgttagttgtctgtacaacagtctttctccctttctttttcagtatgagaatcctcattttggtcaggcctatagtgtgtccagataagagatatttcccagcttcccttgcagcaggttgtaaccatgtgactaagttctgggtaatgtgatatacaacagtgttgtgttagacttcaaggaaggctgcatgagaggaggagacccatctagaggtaagcgccttcaccttgccctcattcttactgcctagcatcccaaaacacggaagtccagccagagtctcagacttttggagcttggaagccgcatgatgggaatttttaaagactagggagaccacaccagccccaaactgcctacctccagaatttatttgtttaagagagaaataaacatcatcttctctgaggcactggtattttgggtttccttttttacataagctgttgtacctaatgctgtctgatgacacagagtatattgagcctgaattaagagcagaatatctagatggagatgttcgataggcagttagaaataaaaataaatacataaatttaataatagcaattaacatttgagtgataattatatttccaggtccttattgtgtatgcaaggaggcatacagaggcttaacagtttgcacaagatatataactgataagtggcagaggtgggatggaaaccctatactctctgatgtcacactgttaactattgtgctgtagggtgggatggagcttagaagaaaggtcacaagaatttatttttaagagaagataagttgagataattctttaaaactactaaaaacacagaagtatttatttgcatacatatttcacaaaattgttttatgacttttaaatcatttacataatatccatgagatccacagtttttacaagtaaaattatgtcaagaaagaaattcagctgtcaatctgaattatagtaattggtgaattagggaagtttattaatatttctcttgtctttttagagatgtttattaagagttctaccaggtccaaacaaatggaaaggcatcgaataactataaagttagaaaagaatttagacattatctggtgcagtgctctgcctttaagatgaggaagtgagacctgaagcagttgagtgactgaaagtggtttatcagagttagggacagaaccaagaaaataattcggccttcttattcatccttaagtttcccatatgccaggcttgaagaaagctctgttgcaattacctctaagttctcactgatcctgatccccaggatgtgaaatggttaagtattatatttagagtacttccacagcagagggggtaagtcaggcacaaatccagccatgctgactatctgttgtaagagaaaattatttgtctcaattcctctttttaaaaaattcagattatgttttaatgtgattatttggctgaagaatatcatggcataaaattcaaattcctccttagagcgtacagggccttctatgatgtgctcgcctgctgttatcacggcacttccccttgctctagccatgctgttcctggacattgttgatcatgttcctaccttagggctgtctcacttacagtcctctcttctaaatactctactattattatctgcagagctgaattcctcacttcctttatgggtagctcatacgtcatttcacaggatatattactacctggtctgtttaaatggaattgtttatttttatatgtattcattagtctgtctgactttgctagtgtcatgaagataggcactttttttttttttgctgtatattcaatgcctaaagtagtatctgtctaacatgtggtatgtattcaataaaaaatgtgttgaataaatgaagatagtacgtgagggctaacttataaaagtagtattctataatacagattgttattttagagcccacttaatagttgttactttctgttttcttaaaaaccattatggaagtactgtaatcaagaggtttaaatatattgaaggccagttactaaaaatagtttatctggagcacttcaggtatgaggccttttcagagtctgtcatctgtagtcaatgtgagctcctttgttcttcaggtattccaaatttctggaatatttctgcagtttctaactaggactaggtgcctggccaccattatcttatggtagtaaatgaccctctagtggcctgagtgagttgatgtattttacttattgttaatttggtgcaactttgaagaattgctttcagaatctaagtctttttcaatatagagagactgaaaattttatgcatacaaatttgtagtcatagaaaataataataataataatggcaaccagtgtttatagaactgtcattatgtgtctgcactgggccaagctctttacacgtgttgaggttttaagtgtgtgtcaccatcagcaggtaggggaaattttctatttagagaaaaatagaccagttcatattcttaaacagaagagacagtgcacagctctacctgccttggaggaaattgtcattttatggtcttaaggaaggagatgaaataagcataataaatagtagtaaaagcagaaacacagtgaaagagacgtaaaacacattcataacaaagccccaggtgactgaaacataacctgtggataaccagcaatgaatgtgtaataggaatgtttcagatgattttttaagacattttattaagtgaagaaatgcaagcctttttattttgcttgacaactatttaattttctagtatgaccaataatacagaaaataaagtgaaaagggtaaaatttctaaaacaaagtggacaaataaatgattttggaaagaaacccaagtacttcaagatagagagaactgcagaataatcagaatcataaaattcaatcttcatcagatggaagtttggtcattcttatttaaacagtgcaaccatcttcatttgctaagtttcctgaagagttaagactactcacaaaacagaaaattccagtagctaacatatggcagcaatgcaatgaaatggaaagaaaaatggccagtttacctgaatattgtctcaccaagacagtttttttaatattctgcaagtggctggagaattgatttgcttgtatatggtttgacagagaaacattttttttttcaatctgggaaagcaattcccagaggatttaaaatagttagagaaattcatcatgtgatttttctcttctcaatgaagctttatctatgaaaatgacttgcatacatagttagtgttgcaataatatggcacaaaataaacaattcttttaaccatggtcatatatcattgaagacacatgcatctagaagttatatgcaatttatggattttctaaatatttaaagtgtcatgaatggctggtcttagttttagtcagtatgtttttattgccagtaagttacagatacagcagacaagtgaacacaaaactgattttgtgattgacttagctgaaagatatgaaacttctaatttaaattctcaaattctataatgcgattctgtatctatttgacgttacttgtaaagcaaagagaaaaaattgctacagcgtaccttgtggaataaatgcaatgagttatcaaatcaaatgaggcaaactgaaattattttgaatcttttttgtatttgagttttcatagttatggctttctaccatttttaaactcggtttagatatcatttcttcagaaaagcttctctgatccctaccaccactaccaccatcccctttcccagtattaggtgcttcagttctacactctcataacacttctacctttcctttttggcacctgatgcccttgcaattgttagtttaaattctctcatccagcctttattacagacaccccaagggcaaggatgatgtcagtcttgttaacaacctaaggtgagtcaagcacattgctccatcagttcttccttctcctgaatcataagctttcccttctctgttggctcatcccatcaatatacaaacatgctattgtttttccttttttcaaaataactctcttgactctatgtcccccatttctaactttcttacaacttttcatcaaaactccttgaaatggttgccaatactagttatctttaattttttcctctttcatccactttagtaacccatcactctactgaaaatgcttttattaaggtcaccaatgagtgccagtggtcaattctcatctatatacattgaagattgttagcagaggttcctaatactttctcagtgaatcagctacagcttggcaactacccacgtcagttttcttccacagaaggtctgttgataactgtattactttcctagggcttccataacaaagtacctcagtttctgcttaatactgcagaacttgattctctcaagttctggtggccagaagtctgaactgaaggtattcagggccacactcactccaaaggcttcaagaaataaagaatccttccctgcttccaatttgtggtggctttcggaattccttggcttgtggatacacaactccaacctctgcctccatcttcatatggacttcttctctgtctgcgtgtgtcactcttctctatgtctcctaataggacaattgtcattagatttagaacccacccacataatccaggatgatgtcatctcaggatcttaactacatctgcaaagaccctttttccaattaaactgccattcaagtttccaggcattaggatatggacatatcttttgtgggggcaccattcagctcactgtgataacgatcccagtgttcactgcttttgttcatagtggaggtatgatataatattctcgaccagatgccaattttaccactaattaattttttaattcaacagatagttattgagtaccccttatgcgtcattataggtcctgaagagaaagtgtaagcaaatccctactctcatggagttacattctagttgagggaaaaatagaattattcttatattacttaaagtacattagtacatttcctaaagttatagaagtcattttttttttttgacataggatcttgctctgtcacccaggctggagtgcagtggtatgatcttgtttcactgcaacctctgccttccagcttcaagtgattctcctgcctcagcctcccaagtagctgggtctactggtgcccgccaccacacctggctaatttttgtatttttggtagaaacggggtttccccatgttggtgaggctggtcttgaactcctggtctcaacggatccacctacctcagcctcccaaagtgttgggattacaggcatgagccaccatgcctggatgagaagtcattttaaacttataattaagtttctaaaagtcacaattttataaaagccagaacatacacaatacaaagcaatcttttccattcagtggttggcagactgcatatcagatgtttcacccacgtgctaaagcaaaagaaaaaaaaaagtgccaaaagtcttattaaatttatgtttatctgttgacaagtgatacaatgtcatgcatttagtgtgattttaaaccccagagtaaatgagaaagtgataccatgatgaccctgatttcgctcattaatgttgtatttataccacattattagtctaattaaaataaatataaacaatgtaccttccatatcatgaagccgatttcaaactaacttctgtttcatttaacacctctcctgcttcccaccttttccgaaatacttaattatgctgttttctttgctggctgtaaattatgtagattttgttactcttactaacactatatgcctaggcacttcacccaccttaaccatcaccctgtattgtgatagcgtcttccatatgcgtactccctagtgaacaatgagctctctaataggagaggccgtatcatttcagtttttgttttcccagcactctacacgtatgtgacatgtagtgggttaaaaatgaattaaacttagtcaactgtaggcttgacaagtacaaggagcaggattccttggatgctgagtgacctagctgtatcaaccaactgtctagtattgggttcttctttgccaatttaactcagtgtccttgtctttgaaaaacagagaataataacaatgaaaggacttatggattatttgtgagacacagtgatgtgtattaagcatgcacttactgtgtacctaactcttagtaagcactctgtagatcttagtcattaactttgcttggtttttgtttttagcattattgctttaaacatctatcctgacaatgaagtggattttcacttatacaaatagcttttaattgaaacacacagaggtttcaatttggcaggacccaaggtttaaaattgtaggcagcttaataaatagaaagtataattaatggctcaaattttgaaagccattaactatattttagtgacatgacttggaagagttagctgcataaagcacacatttttataaaaagaaaggtaagtggtgatgttttctaagctttctactgtttctcccaagcacctttttttgagtggatgtcatccttaacttttcccattcttttatattttatatttgacaattcactatgttttaaaaagggtttcttgggccggatgcagtggctcacacctgtaatcccagcactttgagaagctgaggcaggtgagtcacaaggtcaggagtctgagaccagcctggccaacatggtgaaaccccatctctactaaaaatacaaaaaattagcagggcgtggtggtgagtgcctgtaatcctagatacttgggaggctaaggcaggagaatcacttgaaccagggaagaagaggttgcagtgagtcaagatcatgccattgtactccagcctgggtgacaaaagcaaaactccatctcaaaaaaaaatttttttctcattaaatatttgttatatgaatctcttctctcttcgtcaatttgttaattctgtcttcactttatcactttgaaaattgaagtcatagaatttaagcaatgaataataatggtacttatataaatgaattttgcttttatattactacactcaaaatacattttcagtaaaaattgtttgaagtgttgcctattaagatgtttttaaataaattctcttgtgtatatttaagatacaaaacattataagacacatctatatagtaaaattattactatagtggaacaaattaacatattcattatctcacatagttacccattccccctacagtgacaagaacagctatatctactcatttagcaaaaatcctgaaaaaaatatactgctattaactataatcctcatgttgcacattagatttttggacttttgttcatcctacatatttgctattttacatactttgacttgcatcttcctatttcctcctcccacctcaaccctttattccttttttaatagattccacatataagtaagatcatgcaatatttttctttctgtgtctggcttatttaatttagcataatgtcttccaggtctatccatgctgtagcaaatgataggatctcctcccttctttaaggcagaataatattcaattgtgtatgtataccacagtttatttcatccatttgtctgtggacacacaggttgctcctatatcttggccatcgtgaatagtgctgctgtgaacatggaagtgccaatgtttctctgtcataatgacttcctgtgctattaatatatacccagcaggattgctggatcttatggcagttttgtctttaattttttgaataacctccagaccattttccataatggctgtagcaatttacattcccaccaacagtttacaaaggttctcttttctccacgcccttaccaacacttgttagctcttgttttttgataacagtcatcctaacagatgtgaggtgttatctcacagtggttttcatttgcatttccccgatgattaaagattagggcaccttttcatgtaccagttagccatttttatgtcatctttggagaaatgcatattcaagttcttcgcccattttaaaattggattatatgttttcttgctattcagtgtcatgagttctttataagtcatggatattaacccgttatctgttgcagggtttacagttttaaaaaataatttgtaggttgtctttttattttattgtttcctttgctgtgcagaagcttttaagtttgatgtagtcccatttatttatttttgattttgtaggctgaattttggcataatacacaagaaataattgtcagggctaatgccaaggaggtttttccgtatttctcctaagacttttgcggtttcaggtcttaagtgtaggtcttttatttgttttgatttgatttttgtacatgatgtaagataagagtcaattttattatttcgcatgtggaaatcaagtttttgtagcactatttgttgaggagactattttttcctctttgcgtccagttggtgatcttgtcaaaaatttgttgactgtgtaagttcgggtttacttttgagctctctactctgttctctgtgtctctttttttatgctagtaccatactgttttgattactgtagctttgtaatataattttaaatcgggcagtgtgatgcctctaaccgtatttttctcagaattgctttggctattcatagtattttgtggttccccatttaaaaaatatcctattaagttttcattttctaaaaaccacactgagttattgaaaaatggagtttttagtccactagtattattttaaaatatctaattttagggattttgtgtgtgtgtgtatgtatataagaaattgttgagagacagcattgagttggggtatggatcataggctccagaaccagtcttccagaacttgaatatgggttctgctacttatagctgtacaactttgggcagaatggttaatctctctatgcctcagtttttttcatttttaaaatgaatttaataatgttatttactaacagttgtgaggattgaatgagttaaatcacttaaaacacttagaataatgctagacacatagaaagaactgaataagtattagttctgcaaattaattaatggagtgaaaaggttttttgttttgttttgttttatttttggttgtgagtacacatagataagtcccagaggcaggaagtcatgggatttttacagagttaagcagtaaaagaaagcccatgaaaatgagacttgggccaggtcttagaggttctgccctcaacattccaaacaagaggccacagtaatcccacatcccgtaggtcatctctgagatcactggcagacttcccacactcagagatttgaaccttattctataggcaaagggaaaatattgaagatagtacagaggctagtacatgggctttagcagcaaactccctggaattggcttctgattcttttctgtacctgagtttcattattgataatagtaatgattcctactttatagggtcttgcaatgattaaatgaggcaatatagctaatatattcagaacaaacttgtctaaccccagctggtcacaatggctttgaatgtttgaatgcagcccaacacaacttcataaactttcttaaaacattatgaggtttttttgcaattttttttttggttttagctcatcaactattgttagtgttactgtattttatgcgtggcccaagacaattcttctgcttccagtgtagcccagggaagccaaaagtttggacatccctgaagaacattgcctggctaatagtaattgtttaatagaaattggctattaaaaattgtgagcaaaggaatattgtgagcagatctgtgtacctttacataattctaggtaaagtgcctgatcttctatatgagaacagagagaaaatgagacgtctgtagaagagtcaagattaatgagtatttcacgcttgtgctacttttccacaaggttggcctggggacatgggtgtggaaaagggaaaaccattgctgaatttatggcagttattgctaagcctcagggggcattaataccatgggatctccaggcctcccttaggtagctagggagcccggggcatgagtagaggaccacattcagagttcatggagaagattgcctctattccatagagtacctttgtgaacattagaagagggtgccactttctttggggccatataaccctgcagcagggcacatggcatggtaaacagagcctaggactcaccccctttgctagatacctttggacaggacacaacctgagcaacacacttatgtcctggccagagagcacttgtgattacgggaaattctgcctagtaagaaaacatgtgcattatttatgtctgtacatcttttgaatttggggtgatcttatgattttctttgataaatagaatgtgatagaagtaattttatgtgacttctaatgctagaccttaagagaccttgcacctttcacttttaccctcttaaaattctgctctgggatcgctatgtaaagaagtctagtccagcctcctggaggatgagaggccatgcagaggagaactgaagtgctctaggtgacagccagcacttcctggcagctgcgtcttcataagtaatcccaggcaagatggcaagaacaactgcctagtcatagagttgctgaaccacaagatcttgtgcaataataaatgagttttaagcctctacattttgtggtagtttgttatacagcagtggataactgatatacatatgtaggccaaaagggaaggaacagaggtaattctcggtctagaagtcatctgtagtgaccgttttctctcagcttccaataaagatgcttccagtgatatggcattgagtcagaacatttccttttcatgaacagagatattactgcatcatacaagtcagtttggtctgtaggagcatcagaaatgactacagagatttccagcatagtttctgatacccaaatggcctggaaatgtctgctggcatattacctttctagttactatgtgcctcataaagacagcaacaaaagactcagcaatattaaaaatgaagaaccaagttgctggtttattctagttatcattatcactgagagtgtgctgttacaatgttgatagtgatgtacgcgtttacgaagaaatgacttctaaaaacactagctagactagaaagtcacataatgaagcagtagaaagtgtagcaggaatctgaagaattgagataaattaaaaataaatgggaggctgggtgcagtggctcatgcttgtaattccagcactttgggaggctggagcaggtggatcacctgaggtcaggagtttgagaccagcctggccaacatggcgaaaccccatctctacaaaaaatataaaaattagccaggtgtggtggtgctcacctgtaatcccagctactcagaaggctgagacaggggaatcacttgaacccaggaggtggaggttgcagtaagctgagatcccaccactgcactctagcctgggtgatagagtgagactccatgtcaaaacaaacaaacaaacaaaaaacccaaaatgaaatacctggaaaaattggaaatatatatacattatatttaccaaatggggaaaattaaataagcaggtgaatctttgtattttggtcaattttactctcatgattctgattttatgaaattattattttctttgattttgcagtgatttttcattagctggaagctacagagcaaattattttgatgccaaagtgaaaaatatggagatatttattggaataatacaaacttctttctctttctcttcttctctttctttcttttaaactaaagtctttcatgaaatgggaattaataatgaatgccagctgccttcacactggattcttgctggaactttcactccccaattcctaatgctcttcttctggtagagcagagagccatgcccaagcagtcaacagactataacctggccttgcttggtcctagaagctgaatacctacctccccacaagagatggcataagagtaagaaatgagaactacagggccgggcacggtggctcacgcctgtaatcccagccctttaggaagccgaggcgggcagatcatgaggtcaggagatcgagaccatcctggctaacactgtgaaaccccgtctctactaaaaatacaaaaataatttagcccggtgtggtggcgggcgcctgtagtcctagctactcgggaggctgagacgggagaatggcgtgaacccgggaggcggaggttgcagtgagccgagatcgcgccactgtactccagcctgggcaacagagcgagactctgtctcaagaaaaaaaaaaaagaaatgagaactacactgagtgtggtaatactgaccctgccacagaaaacttgacatctggtactatggtctctcaaatttaaagctctttcttcctaaggatgaaggagtaagggtgaaaggactgggtagaggctgggacaagggtgggaaaagacctaccctttgagattaaattaagagggtatagggtgtattacctatgctttttttttttttttgaggcagtgtcttgctctgtcacccaggctggagtgcagtggcataatctcggctcactgcaaccactgcctcctgggttcaagcgattctcttgtcttagcttcctgagtagctgggattacagatacatgccactacgcctgtctgacttttgtatttttagtagagatgggttttcactatgttggtcaggctggtcttgaactccctacctcaggtgatctgcccgcctcggcctcccaaagtgctgggattacaggcatgagccactgcgcccagcctgatgtatgctattatatgccaaaatggaaagggtattcagcttctttttatggggaaaatgtcaaattgattcagttaaaatagaagaaatattagtgagtgtatcagtagtaattatgcttgagtagcatgaaatcaaactgaatttgaatcatggctctgctacctgctagctgggtaaattgggcaaattactcaatttctaagccatagtctccttgcctgcaagataggaataatcacaggtcctgccttgcaggattactgtcagggtttaataaagcaaagcatttaaagcacttagcacattgcctagcacacagtcagtgctcactaagtggttgctactattgtggcataagtcttttatttagataacaaagcagcttacattttaatttatatgttattttaagtaatttagttaaaaccaaatctcactttatctaaaaactacaatatgattaatatgatttataattagtgtcactgttattcataaaaactatataaaatggacaaataggtcaatgttatcaggggatacagtaaattagaagcataagaaaaagtttaggataaatcatttataaccttgctaaaagggaataatattgccagagagatactttgtcagggagaattataaaatgagtacattctcctgtgttttgcgttgcccaatccttcaaattgctcaattgagtggttacttctgagtcctcattttgtgtgacttagcagcagcatatgacaaatgatcgccattccctccttgaaacatatccttcacttggctgctaggacaccacatttgcctggctttccttctccctttccgtctgttccttatcagtttttttctgattcctccttatctgcccagcctcttaatattgaaataacccgtggaacactctttagggctcttttctgactacattcactccctaggtgatcgcattcagtctcaagttgagttacaatctatgtgctgatgactcccaaatttgtatctttagtgtgtgtgtccctcctttcaatttcagacccataaaccaactgcctattttttatcttcacttgaatatccaactccacatatccaaaatcagcttcttctgtggccatcaccgtctcagttaatggcaactcttggtattcctgtttttctctcacacataacgtcatgtagttcagcagaaaaccttgtcagttctaccatctctgtgtgtgtgtatatatatatatgtgtgtgtgtgtatgtgtttgtgttccatatatatatgtagagagagagagttcaccatcacccattacacccctatgaccaccatcatcctgcttcaagccagcatcacctctctcctggattgctacaatagcctttgtctccttgcttctactcttgcccctctgtagtttgtttccaacacagcagccaatgtggtcttgttaaaatttaaattagattatgtcatttttctgctcaaaacccttcagtggctttccttttagggacctgggtaaacagcctcctattacctttctgatgccatctcttaccactttctccctggttcatcctgccccagccacagcggtctttctattgaactttaacgcaagctccatgagggcaaggatttttgtccattttgttccctgcatatctccagcatctagaccagcacttggcctaaagtaagcactcattaaatatttcttgaatatattatggacaacttctgaacccatctcttttgcacaattttcccataaaggtcattgtataaggcatcaatgtatgtatcagtctttaccagaagtctgaggtaatgatgagatatttgttcatcatcatgttatttaatgtgtttcttcctcaagattactgacacatttccccaattccccattttcctggttgctgtcatcctctgactcattcccttccccagaacttgattcctttgtttatcatacagtgtaaaacagtcctcttctcctgtgctggactaggtctggaaaagtttaatccatggcttgggaaaaaaagactggaaaaatggcattttcctgtttcctttttaaaatttcagtgctttgatgtttgattttaaaaatcatcgcaaggatagttctaggggcaaaacttaaagttggctttgttaaggtaacaccaattgccgtaatacataattctccaaatttcagtggctttacacaaaaaggacttttgcttgcttcatgcacatctagttccaacagtcatttctgatcactgggcctctaagtggctccttcaataatgcaaacctgccatcatgcaagtttgctgtggaagagggaaagagtatagaatattattgagggatgttttataggacatgtttgtgactatacatccactactattttactgtccagaatttggtcatacctgaatgctggcaagtttggggcatgtgattcacatgtatacctaggaagaagcagaaacaagtttggtgatgacccatccagagtctctaccaaactttgtattgccacactttctctctcactccttattcataagcctctgatgtgtggatcctcttcttgcttggtgttggatggaatcataatagtaatagtataaataataaatattttctgctattcactgcttatattatttaattatcaaaaactgtgaggtaggtctacttatcaccatttatagatgtggaaattgaggcattagtgtgtctaacgtcactaacttgtaagagttgaaaccaagatttgaaccaggctgtctgacttcacaatccacctccctaacaaggacactgtattgcctctcaagttttgaagagttagacctcttttcccttattatattgcttcttgaggagccaggatgaacctggaaggaactttgggaccccatttcaacttcaaatttcctccattcatttgctgatttgacttctacacttatgtctccaattcttaaccagaatgactcagggcctcccagttctcagatcagtttcagacagagtggcaacttgaggctaaagggtgaaggaatggagccctgtttgtgtaagaattctctcagagtatttcattgtgggcacttttcacagttccaactctcctaattgaaacacatttcaccaaacactccaagtgatatggtaattaaaattaaatctgttgccaaaaaaggcaaagaaaatagtataagcagtctataaactattataatatcacctgctaaagatatttattctggagaaaacaatgcctataacttataaactgatacaacagagtgctattttttagttttatcggagccaccaaaatacaatatatatcagatactgaaatgacttagaagatatcaagatgcagattttcttttttattttttcctttttttgagatggagtctcgctctgtcgcccaggctggagtgcagtggtgctatctcagctcactgcaacctccacctcccgagttcaagtgattctcctgcctcagcctcctgagtagctgggattacaggcacccaccaccacacccagctaattttttgtatttttagtagagatggtatttcaccatgttggccaagctagtcttgtactcctgaccttgtgattcacctgcctcagcctcccaaagtgctgggattacaggcgtgagccactgcgcccagccgatgcagattttcaaaggaaatgttcaactaatggatttcatcccccaacaagtgtattcaaaagtcaggtttttcgagattaaagattttgtgaggacaatttctttggaaaatagcatctgctgttatttgccaccttttatcccatggcaagggagggaagtatgtgtgtacgtacacgtgtgtgtgtgtgtgctgtgactttcttcacacactgcctataggaagaggcctcagaggagactctaggagtttattgtctcccccagacttgggagagtacagctagctcatgtctgatgtccacctgaggtatctgaaagtgaaaagctgtcaaaaagggcctttggaagctaagtagagggctgtgtttgggctgtaactgaactctactccagatgggccaaaggtctgtgactcctggggaccagacatgggacccagagaagcagacaccactgtccaaagtaattttgactcctgcttgagaggactgccagagaccgcagagcaacttcagcagtctttgagtaatggaagatgggaaaactagaggctgagggggaattagctgctggagggttagaatgaatagtccatgtcaccggagttacaatcaaaagaggacagtagaagagcacttgagaacccatgaaaatgtgtgtgtgtgtgtgtgtgtgtgtgtgtgtctgtgtctgcatgtgtgtatctgagagagagagagatgtaaacatctgcgaggccaagagagtgtgaagccattttacaatagtattagtcaagtgagaactttgcagcccgtctttcccacatctctctttcatttagaccctagagaggtcagattaccacagtccaaagtaggggaagagggatggtagtctaacctttgaataaagattcaattgctgtttaatttgttagacaaacttcagtgtactaaattgagactctgttcagcaactaatgtctttttattacctatgaatgtccagagatgtcatggagcctgccagagttttcattcgttggaaagggaaaaactttccctagtgaatggattttttaaacagtggggccaggcgcggtgactcatgcctgtaatcccagcactttgggaggccgaggtgggcagatcacttgaggttaggagttcaagaccatcttggccaacatagtgaaaccccatctctaccaaaaatacaaaaattagccaggcatggtggtgcatgcctgtaatcccagctactcaggaggctgatgcaggagaatgtctttaatctgggaggcagtgagctgagatcatgccactgcactccagcctgggcaatagatcgacactccctctcagaaaaaaaaaagaaagaaagaaagaaagaaaggcggtgagagacaaacataacattgactttggattttatcacatgatttacattcatgattacatctcatcatgcagtgcgttgattgtgcttgttatacggaatgtattgctcctcagcaaatatggattttctaatatcactaatttttaattcagaattaatatttgaatgtattaattttctgccttttagagagtaatggagtattgtataactcattgaggattgatcggtatgtaccttaaatcttaaacaatttgagaattattaacaaatctataattaagtctaccacttagagaatcttttctctggcacaataggaaagttaggttctagttgaagaaactgaagaaagaggaggcagttttgaggtctttatttggccattagcttgctttaactaagaaggtttttttttcctgtgctttttttacccccttatctgagtccttgtaaaaagaaacaatatcctcagtgtatgctaaatgcttgacagattaatttttctgcatcacaattgaaaaagttgctcttaaaccagagaaatgaatagatggttctttgtagacttacttggcattgttttcaaggagtttctctgaccatgtcacatagtggatcaatcaacagactttttcagcatccactaaatacttattattgtgcttggcaccacaggatttggaattcagtccaaataaattcaatagattataattgagtactatcccatgttagacactgtgctaggctctgagaaaattagcatgaatgattaaacccaaggtatgtagtctggttgtgaaatacatgtataactaatactgtacatagtgggatgaatgtcaaatgtggagtacaaacaaagctgagtgttagtagtgatgaggaaatgattcattctaactgaaaagattgaggactacaaaataataggtatcatttatgaataacccgagatggtacaggtactctataaagaattgatatttataagtccccttgggatagttttcatatcctcattttattggttagaggattcagaaaacttaagcagcttgtccaaatcacatagctagtagttatcagaatcagcaactagaatctgagtctgtttgatttcaaagcctatgttcttattagcaacactgtgacatctgtgcttgcaggggatcatttcagattaaaaggagcagtgtaaataaaggtacaggtttaagaaggaagtgttgacaggtaggttgtagtccattgtgactaggcatggcttagaagccctggaaagactgaaggcatattgtggaagattttgaattctatgctaagagattggactttattctaggtatagtcactaaaaaattataaaaaacaaaaaagacaaatagacaatgacaatatctaataggtgctaattatctgatgcaaatcagtgtatctcaatgtaatttaaaaattgtgctattattaatacaatgacaatattaaaaaataatacgtcatctaaatcaccttataactgagtccaccactgcaactgtttgcttttctgttcatatgcatgttggttctaagaagtacacattgggctaatgagaatagaacagaaacaaatttcatgtgtaaatgacaccattttaggaagtgaacgtcaaatgatgttagactgcacacactgaacaaataatgtgttcatattaatgaggagagagaaaaggagtgagagacgcttatcacctcacagctcactgtggcctatgcacaacaggcttctaggtcttgcatcagcctcatatcttcagtgggagtagttagcagaagtaaaaatcacattgagttaatgttaatttgaaatttattgattttggtatttaatatataactttgctttggtttcataattacataaatgttatgaccctaaggagtttataacattttaagttagcatggatttaaatacaaatatgctatatagttatacttaaggctaacatgggagacccagaaacgtgtttttctcttaagtttgaaaaatacttcatgaacaattcctactgagaaacattaacatagtacctgaaggaaaaggggctagaaggtggggacgaattccgaatgaaataggattataagcagaaacacagaaacaggaatgaagagatggttacactagagcatgaagttcgttttgtggtaagtaggcaagagagccagacaattaagaaactcatatcactgaagtttcatatcaccatagaaaggggtcaatatggactcttcaggaagataatgaaaatgtgacttaatttgagttacccccaaaacacactctgagaagaggatttgaatgaaggagttttttggggggctggtcccaggaagcactggtagaggcttggtgaagtgagacagaggaggaagggaggaccataaagagtatgttacctggccgggtgcagtggttcacacctataatcgcagcactttgggaggctaaggcaggtggatcatctgaggtcaggagtttgagaccagccaggccaatatggcgaaaccctgtctctactaaaaacagaaaaatttaaaattagccgggcgtggtggcacatgcctgtaatcccagctactcaggaggctgacacaggagaattgcttgaacccaggaggcagaggttgcagtgagctgagatcatgccactgctctccagcctgtgacagagagaaactgtgtctcgacaaaaaaacaaagtgtgttaccccaagcatgttacctctgtgggtcactagagcttaatcccactgggaactctgggagcaaatgcagaacatgtgccttggggctatcccttcaatggacagagaggctggaatgcttattcgccttcttccaccagcatttggttgagagatttcccagggcacgtagactcagcggcaggcctagcctgaggcataagaaacaaggcagtggctggaggccaaagaaagcccccaggcagagcaatgcaggcactggcagttggaagcagggctgtgtgcaagaaagtggtaaggccaagggaatatgggaggagcgtccagtgtctgctaagtgaccttttacctttttaagactgtccattttgtggacaaaggacactgacatttcagagtttctgtcatgtgccttgaattatgctgaacacttttacatttgaattttataaaaattctgtggtatatttattttctccatgagggggtggaggggatctccaatagcacataaagctcacgctcagaaagtttagtacctcttgaaggtgacactgctgagtcatgttgaagttagaattgggagaggattttgaacccaggtatttctgacccagaggcttctgattcttctatctactgatggaatggagaaactagaaagagtttggaaattacaaggatagaagataataatgaatttagattgtgccctatttttcatttatatgtttattaagaaattaatttttttctttattctaattgcacatggctaataacagtctcattttcaatgtgttaaataataaggtttttgtgtccttgagtatttattttggagatacatgacatagaaacatcttaacatttagggataatattcttttatgatagtgtttctcatagttaatctgaagtttttaatagaatcagtaataataatgacaatatccatcttatattattcttgtaggacttttcattataccaaataaattactaaattaattttagtgagtcattacaataggtatgtgacaccagtaacagtcttattattaccaacttaagaagaagctaaagttgaactcagtggcttgtctgatgtaattcagctcatctttgatgaagtcgggtctgagaactgcattatttccggatttgtttgtggaatgcaagtgtagctccctttatacaatgtgcagttctgaaaaagtgaattgttattactacaaatcttattattcaaagcaatcctattgtgaatcctttggtaaaccgaatagcttgtcttttgttcaaatgtggattttttgcatttagatttgcctgaaagtaaagagtactttggccatttttgccttggaaatcattatatttgtttcttgatgcacatcttacatcttgaggttttcctcttatggcagtcatagagattttcctttgaatgtgtctttccacttacggttgctgcaatctcctgcagcatttgtactggttggtatcatttctcaactattgatttcaattaccttatctaggtccttaggacaagaagtgagaaatatgatacccaactctaaagaaagaggttttgaagggaaatgtgctggaatgtggatagagcttttttctgttctaacatgagaatcaggactacctacattcattgatattggtgctgatagtgttattgcattcctatggacattaagaccaccaaggcctgcatatgacttgtactttcaggcctgagaatgcttgtagtttgtcagcggtttgggaatatggttcccctctgatgtgtgtccctacttagccctgtggatttaggctcctcttcttgaaatggtgccatctatctttgatcactgctgtcatttcctaataacccacagcttcagactgtttggctgtgttgctttggagtgctttttttcctgcttaccttgcatgtggttgttccagttcatctcatctgactatataagcagttacttaggaattctgttgtaatctgtctttgcattcctaacctcgtgaaactgaggcatatgcagcatgcttcagtgatgggaagttgatcaaatgctttaagtacgtgggattcattgatgtgtcgaatgttggacataagcaaccttcattctgccccttcatcttattttatattactttaaatagtagaatgtactgtattcctcgttataaatggaaatcttagaacttgataaaaatttaaaagaaattacctatagatccactacctaaagaatgccactcttaacagttttttccatttaattacctgtgtccagttcattaaaaatacatttatagcctatatataattttatattttgcttcttatatttaacaggacatgattggcatttctgaatgtatataattcataagtataattttaatatttatatactatttagaaagagttttcataccttaatttatttaaccaaacccctattacattatgttttaaatatttcaatgcatatcaccaaattgtcttccaatagtgtaataaaaattcacattcttattagcaatgtatgatagtgtctattttactgaaccttgttcctctatagctattctaattaataccattgtttctggtaatctgctggacaagaaatgccatcttcttattttaaattgcatttattaggcttatagcaaggatgaaaaattgttgtatgtttttaaaattctattctttcttataaaatttctatttatattctctgttcatttatctattagtttctcagtggttttcttattggtatgtatgagtaattttcatagtaaatatattactcctttaccatatcaactgtatatatttttctagttcttatttttaacattcaatagctgtaaatttttatgtagctagatgtatgatcctttattccacatgagtttttttttttgtttgttttcccagtgaggaaagtattcagctctaagtaacagaattcctaattaacagtgacttacacaagagagtggtttatttttcttgcataaacagaagtctggtggtaggttgtaacagcagtggtttagtttctcagtaaaaccgttttagaaccaggcttttttttctctttgttctatcatcttttatcattatcagatttttaaaaatatataagcaacttcttcattaagaaagctaaggcccagagaagttaagtgatttgtccctgctactcagctaatggagtttcctttttctgtctctacactctttttttttttttttttttttgagacggagtcttgctctgtcgcccaggctggagtgcagtggtgagatctctgctcactgcaagctccgcctcccgggctcacgccattctcctgcctcagcctccctagtagctgggactacaggtgcccaccaccacgcctggctaattttttgtatttttagtagagacggggtttcaccgtgttagccaggatggtctcgatctcctgacctcgtgatccgcctgccttggcctcccaatctgtctctacactctttctgttgcactgtgctgtcgcatatcttgctgtgcatttcacattggtacctgctattggcatacaaaacacatacaaatatgacttcgctctgtactccctcaagaggtgtccaggcaatattatgtattagcaattaacacctcagctattaaattcttttataataaaccataatttaaaataacatgggaattcagtatctgctaagttgaaaactttatttactctcattgtatttttgcagatgtgacagaactttttgatagaaagagctcaaatgtttaagagcatggttcaattcttattttatgtattaaaaactaatttgtagcaggagatcctgaaacctactgaagtgaaatatcagacaggctttgatcaacgaaagaaagaaatactctcatcaatctttgtaagcctctcattggtaaatctaaatcaacatatataaagtctatatctgtgcaaagcattcaacctgcccctgtggtaactgagctcgtaaattagttgaggagacaagagcaatagataatatttaatccacaaaagatgtaaacagtagttgaaagcaactataaattaaatgccacagagtagggcatgtctactttctaagcaatagaatacataatattttcttaacttcacttgtctatgaaccaacatcattattttttgccctaactataaagtttatttaaatattaatatattttttctttaaaataactttgaagcaatttagtttataaaacttaatcttgctgagtgataatacccatgaactcatgaattcaatcttctagctgtacttttttgtttttaactgtacatattttaacacattaaaataaatgtattaaaaaaatggtcttcatgtatcatctaaaaattatcttatgtctcagtctttgggaaacactggcttaaacaatcaattactagggagttcagatgaggaacaatagaacaaatttgcagtgattctattaaaatatatgaattaaagaattctcttgttcccctaaggccataatcaaaattatagttcagatatattgtctgctaggtaatagcatattaataaggatttcttatgtgttcatagatattttatataatttagctttaaaaacagccttcagataacagtctttcatgagtgttgaaaagacttcagtttcattcttaatctttcagtaatagatcccaggagtgaataaggttacgcatttcacttttataatcatctttgctcagtctgctgaaggtaggaatgccttaatatggcatagcacagtattttttctaggctgctttataatttgttgagaatgattgcaaatcttactaaaagcaattcagatacttcaaaaagagctcatcattcatgattaaagacacataagcctaaagaagtatctccagctaattttgaagaatcattaaaatattttgggaatcagccctcttaaacaaatataacaaaatttagaattctgtttacacttagacatttctaggcttatattcattagcccataaaatccagactatagattaaagggaaacattttaaaatgttagctgttttgaatggaaatctttctaaaatatactatgcaattctaggcctgatagtgaacaaaacatacattttctttaagactcaggatctttttttttttttttttttttgagactgagtctctctctgtcacccaggctggagtgcagtggtgcgatctcggctcaatgcaagccccgcctcccgggttcacgccattttcctgcctcagcctcccgagtagctgggactacaggtgcccaccaccacgcccggccaacttttttgtatttttagtagagacggggtttcaccgtgttagccaggatggtcttgatctcctgacctcgtgatccgcccgcctcggcctcctggtttccgttggactttattttgcagctattatgcttgtctccctaatacgcctctacttttactatccttcttcaaatgtgttactcgcagtattctaagacctcagaattacatagtggagtttgttaaaggtatcattatagcatcagaaagtggagacatcaggggcttttttcttcctacttctaattcagggtagtgttgtgaatggttgcagttgtgagaggattaaagattcattaagtgagctgtttagtgaactattttctagtttttattagttttgattctgaatgatgatcgctttattaatgcttcatcaacacactgggatttacagctttcaaaggttacttttatatgcaagattggatttggtctagactgtctgagtttactaatgtttaccatcttgagaactgataaagtgaagacattcaccaaacacttagaaaattttaaagacataccttttaactggctatgacatagcaaagaaatattctctttcttttacaactctgctatttagattctatccgtttatacttctcatcttagttgcatacaaaaattcacatgtgtacacactccccccgtacacatacagagaacaataacttttattatttcattcattcccttggggatcaaatatgtgtccaatgagaagatccaggatgtcatactaccatataccaaggagacctttgttggggaaacaagttgagaaatgatgatccgttaatgatgtccacagcgggggctgcaagacatcttactgacaagagaggaagaaaatactggaagtagtacttatatttatatcataaattaaaagtcagagggctgggatcatgcctgtaatcctgacactttgggaggccgaggtgggtggatcacttgaggtcaggagttcaagaccagcctggccaacatggtgaaacctcatctctactaaaaatacaaaaaatttgctcggtgtcattgcacgtgcctgtaatcccagctacttgggaggctgaggcaggagaattacttgaacccaggaggcagagtttgcagtgagcagagatcacgccattgcactccagcctacatgacagaacaagactccatctcagagaaaagaaaaaaaaaaagagtaaataaagacttactagtaatcaatatccagagcttacaatttagatatttagatgaggtatcttaaatgaagactatttgacaatccagtggagttcacagaagttccttctttaaatattaactttccaattattgaaatattttatgattgtggcatattttaacatatttcaacaagatgatataatgttaattttatacaagtaagactttaaaaattatggatcattagaatactttttaatgagatgaggaatgactgggaaaatattttgaattacattgaggcccacagtttttctggtgacaaagttcttgaaaatgttatttaagatgagttatatagatttacacaaaagccaggcttctgatttggttgatgttttctgtggccatctgtggcagtcagaaagcagttattttggcatgaggttcagagagcttctaggttggtgagcacatggaggtgctgtgagtgtggtgtactctgagagggcatgaaagccccttcccctttactttggcctatggatcccatccatttggctgttcctgagttgtatcctttacaacatactactaaatataaaagaagggaaaaaaaaggcaagcagttatgttgaaaaacctgaaatatactgaattagtctcaaacacaataaagtcaatgttttagtaatgagtgaaaaattaagtgcttttcaaaaggagcccatggagaaagcattctgaaatggctatttggcaaggctgtcatcattttgttttactgtatgttcttttcttaaggatctttgaattgtagactagtttacatactttataaataatctaggttaatattggcaacacatgtaacagatattatacttttataattattcagaaaattatatatacctttaatccctccccaatactcactttaataaatattaatttattaccaaaagaaggtgtgagatctaagaactctgagtcttgtagcaggtaagacatttgtaagggctacttcttaataaaattttccatttcctttagatgtttctaaaattagaagttttaaaatatattcgtttgatgtgattacttaggggctcaagcagagaatttagattgattgggcttgcaataaaaagggactttaaaaaatgacatcatcagaaagaaggcaaataatcagctctttctggatcaggaaggggaattctgacaaatatttatacttatgagacatatacatgggtgcaagagaagtgacatcggaagaaaaagtacacatttttgtatttaaaaatctatcaatattatatatgaacatctgaaagatatttatatataaatatacatgtaaatattatggcatataaacagatttatatatgtgtgtatgtatgtaggtaggtatctacctatggaatatactttttcttcagaagtcagttcttttgctttaaaactttctcctttaggaaaaaaattaacactgaattttaccagttctaatttttttttactttaggtttttgtttatctaaatgttataaataatgagcacaaaataattttatgattattatttcatggatctgtttctgatagatttgttaaattatactttaagttctgggatacatgtgcagaacatgcaggtttgttacataggtatccacatgccatggtggtctgctgcacccatcaacccgtcatctacattaggtatttctcctaatgctatccctcccctagtctctcaccccctgacaggccctggtgtttgatgttcccttctctgtgtctatgtattttcattgttcaactcccacttatgagtgagaacatgtggtgtttggttttctgttcctgtgttagtttgctgagaatgatggtttccagctccatccatgtacctgcaaaggacatgaactcatccttttttatggctgcacagtgttccatggtgtatatgtgccacattttctttatccagtctatcattgatgggcatttgtgttggttccaagtctttgctattgtgaatagtgctgcaataaacatacgtgtgcatgtgtctttatagtagaatgatttataatcctttgggtatacacccagtaatgggattgctgggtcaaatggtatttctggttctagatccttgaggaatcgccacactgtcttccacaatggttgaactaatttacactcccaccaacagtgtaaaaaccttcctatttctccacatcctctccagcatctgttgtttcctgactttttaatgatcgccattctaactggtgtgagatggtaacccactgtgattttgatttgcatttctctaatgagcagtgatgatgagctttttttcatatgtttgttggccgcataaatgtcttcttttgagaagtgtcagtatgatattggctgtgggtttgtcataaataacttattattttgagatacattccatcaataccaatttattgtgagtttttagcatgaaggggtgttgaattttattgaaggccttttctgcatctgttgagataatcatgtggtttttgtcattggttctgcttatgtaatggattacgtttattgattttcatatgttgaaccagccttgcatcccagggatgaagccgacttgatcatggtggataagctttttgatgtgttgctaattcagtttgccagtattttattgatgatttttgcattgatgttcatcagggatattggcctgaaattattttgtcattgttgtgtctctgccaggttttggtatcaggatgatgctggcctcataaaatgagttagggaggattccccccttttttttttatcgttcggaatagtttcagagggaatggtaccagctcctctttgtacctctggtagaatttggctgtgaatctgtctggtcctgggcttttttgggttggtaggctattaattactacctcaatttcagcacttgttattggtctattcagggatttgacttcttcctggtttagtcttgggagggtgtatgtgtccaggagtttatccatttcttccagattttctagtttatttgcatagaggtatttatagtattctctgatggtagtttgtacttctgtgggatcagtggtgatcgcccctttatcattgtttattgtgtctatttgattcttctgtcttttcttctttaacagtctggctagtggtttatctattttgttaatctttttaaaaaaccagctcctggattcactgatttttttgaagagtttttcttgtctttctctccttcagttctgctctgttcttagttatttcttgtcttctgctagattttgaatttgtttgctgttacttctctaggtcttttttttttattatactttaagttttaggatacatgtccacaacgtgaaggtgcaggtttgttacatatgtatacctgtgccatgttgttgtgctgcacccattaactcgtcatttagcattaggtatatctcctaatgctatcctttcccccacccccaccccacaacagtccccggtgtgtgatgttccccttcgtgtgtccatgtgttctcattgttcaattcccacctatgagtgagaacatgtggtgtctggttttttgtccttgtggtagtttgctgagaatgagggtttccagcttcatccatgtctctacaaaggatatggctgcatagtattccatggtgtatatgtgtcacattttcttaatccagtctatcattgttggacatttgggttggttccaagtctttgctattgtgaatagtgctgcaagaaacatacgtgtgcatgtgtctttatagcagcatgatttataatcctttgggtatatacccagtaatgttgggtatatacccagtaatgagcatggaatgttcttccagtaatgggatggctgggtcaaatgctatttctagttctagatccctgaggagtcgccacaccgacttccacaatggttgaactagtttacagtcccaccaacagtgtaaaagtgttccgatttctccacatcctctccagcacctgttgtttcttgactttttaatgattgccattctaactggtgtgagatggtatctcattgtggttttgatttgcatttctctgatgaccagtgatgatgagcattttttcatgtgttttttggctgcataaatgtcttcttttgagaattgtctgttcatatccttcacccactttttgatggggttgtttgtttttttcttgtaaatttgtttgagttcattgtagattctggatataagccctttgtcagttgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctagcttttcttctagggtttttatcattttagatctaacatgtaagtctttaatccatcttgaattaatttttgtataagttgtaaggaagggatccagtttcagctttctacatatggctagccagttttcccagcaccagttgttaaacagggaatcctttccccatttcttgtttttgttaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggctgtattttggttccatatgaactttaaagtagttttttccaattctgtgaagaaagtcattggtagcttgatggggatggcattgaatctataaattaccttgggcagtatggccattttcacgctattgattcttcctacccatgagcatggaatgttcttccatttgtttatatcctcttttatttcattgagcagtggtttgtagttctccttgaagaggtccttcacatcccttgtaagttggattcctaggtatgttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctaaatatacaatcatgtcatctgcaaacagggacaacttgacttcctcttttcctaattgattgccctttatttccttctcctgcctgattgccctgaccagaacttccaacactatgttgaataggatggtgagagagggcatccctgtttgtgccagttttcaaagggaatacttccagtttttgcccattcagtatgatattggctgtgggtttgtcatagatagctcttattattttgagatatgtcccatcaatacctaatttattgagagcttttagcatggagggtttttgaattttgtcaaaggccttttctgcatctattgagataatcatgtggtttttgtctttggttctgtttatatgctggattacgtttattgatttttgtatgttgaaccagccttgcatcccagggatgaagcccactagatcatggtggataagctttttgatgtgtcactgggtttggtttgccagtattttattgaggatttttgcatcaatgttcatcaaggatattggtctaaaattctctttttttgttgtgtctctgccaggctttggtatcaggatgatgctggcctcataaattgagttagggaggattccctctttttctattgattggaatagtttcagaaggaatggtaccagttcctccttgtacctctggtagaattcagctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgcgtagaggtatttgtagtattctctgattgtagtttgtatttctgtgggatcagtggtgatatcccctttgtcattttttattgcatctatttgattcttctctcttttcttctttatgagtcttgctagcggtctatcaattttgttgatcttttcaaaaaaccagctcctggattcattgattttttaaagggttttttgtgtctctgtttccttcagttctgctccgatcttagttatttcttgccttctgctagcttttgaatgtgtttgctcttgcttctctagttcttttaattgtgatgttagggtgtcgattttagatctttcctgctttctcttgtgggcgtttagtgctataaatttccatctaaacactgctttgaatgtgtcccagagattctggtatgttgtgtctttgttctcgttggtttcaaagaacatctttatttctgccttcatttcgttatgtacccagtagtcattcaggagcaggttgtttagtttccatgtagttgagcagttttgagtgagtttcttaatcctgagttgtagtttgattgcactgtggtctgagagacagtttgttataatttctattcttttacatttgctgaggagagctttacttccaactatgtggtcagttttggaataggtgtggtgtggtgctgaaaagaatgtatattctgttgatttggggcggagagttctgtagatgtctattaggccctcttggtgcagagctgagttccattcctggatatccttgttaactttctgtctcattgatctgtctaatgttgacagtggggtgttaaagtctcccattattaatgtgtgggagtctaagtctctttgtaggtcattcaggacttgctttatgaatctgggtgctcctgtattgggtacatatatatttaggatagttagttcttcttgttgaattgatccctttaccattatgtaatggccttctttgtctcttttgatgtttgttggtttaaagtctgttttgtctgagactaggattgcaacccctgcctttttttgttttccattggcttggtagatcttcctccatccctttattttgagcctttctgtgtttctgcacatgagatgggtttcctgaatacagcacactgatgggtcttgactctatccaatttgccagtctgtggcttttaattggagtatttagcccatttatatttaaggttagtattgttatgtgtgaatttgatcctgtcattatgatgttagctggttattttgattgttagttgatgcagtttcttcctagtgttgatggtctttacaatttggcatgtttttgcagtgcctggtaccggttgttcctttccatgtttagtgcttccttcgggagctcttttagggcaggcctagtggtgacaaaatctctcagcatttgcttgtctgtaaagtattttatttctccttcacttatgaagcttagtttggctggatatgaaattctgagttgaaaattcttttctttaagaatgttgaatagtggcccccactctgttctgacttgtagagtttctgctgagagatcagctgttagtctgatgggcttccctttgtgggtaacctgacctttctctctggctgcccttaacattttttccttcatttcaactttggtgaatctgacaattatgtgtcttggagttgctcttctcgaggaatatctttgtggcgttttctgtatttcctgaatttgaatgttggcctgccttgctagattggggaagttctcctggataatatcctgcagagtgttttccaacttggttccattctccccgtcactttcaggtacacaaattggacgtagatttggtcttttcacatagtcccatattccttggaggctttgttgatttctttttattcttttttctctaaacttctcttcacgcttcatttcatttatttcatcttccattgctgataccctttcttccagttgattgcattggttactgaggcttgtgcttttgtcacgtagtttttgtgccttggttttcagctccatcaggtcctttaaggacttctctgcattggttattctagttatccattcgtctaattttttttcaaagtttttaacttctttgccattggttcaaacttattcctttagctcaaagtagtttgatcatctgaaaccttcttctctcaacttgtcaaagtcattttctgtccagctttgttccattgctggtgacgagctgcgttcctttggaggaggagcggtgctctgatttttagagtttccggtttttctgctctgttttttccccatctttgtgattttatctacctttcgtctttgatgatggtgatgtacagatgggtttttggtgtggatgtcctttctgtttgttagttttccttctaacagtcaggaccctcagctgcaggtctgttggagttttctggaggtccactccagaccctgttttcctgggtttcagcagtggtggctgcagaacagcagatattggtgaaccacaaatgctgctgcctgatcgttcctctggaagttttgtctcagaggagtacccggctgtgtgaggtgtcagtccgcccctactcgggggtgcctcccagttaggctactcaggggttggggacccacttgaggaggcattctgcccattctcagatctcaaactgagtgctgggagaaccactactctctttaaagctgtcagacagggacatttaagtctgcagaggttattgctatcttttgtttgtctgtgccctgccccccagaggtggagcctacagaggcaggcaggcctccttgagctgtggtgggctccacccagttcgagcttcctggctgctttgtttacctactcaagcctgagcaatggcaggcgcccctccccccagcctcgctgccaccttgctgtttgatctcaggctgctgtgctagcaatgagcgaggttccgtgggcgtaggaccctccgagccagttgcgggatataatctcctggtgtgccatttgataagcctgttggaaaagcgcagtattaaggtgggagtgatccgattttccaggtgccatctgtcacccctttctttgactaggaaaaggaattccctgatcctttgtgcttcccgggtgaggcgatgcctctccctgctttggctcacgcatggtgcgctgcccccactgtcctgcacccactgtctggcactccccagtgaggtgaacccggttggaaatgcagaaatcacctgtcttctgtgtcactcaccctgggagctgtagactggagctgtttctattcggctatcttggctccaccccttctctagttcttttaatagtgatgttaggatgttgattttagatctttccagcattctcctgtgggcatttagtgcttcacatttcccctaaacactgctttagctgtgtcccaaggattctggtacgttgtgtcattgttctcattagtttcgaagaacttatttatttctgccttaatttcattatatatccagcagtcactcaggaacaggttgtccagtttccatgtaggtgtgtggtttttaatgagtttctttatcctgagttctaatttgattgcactgtggtctgagagactgtttgttatcatttctgttcttttgcatttactgatgagtgttttacttccaataatgtggtcaattttagaataagtgtgatgtggtgctgagaagaatgtatattctgtagatttggggtggagagttctgtagatgcctattaggtctgcttggtccggagctgagttcaagtcctgaatatcctttttaatttcctgtcttgttgatctgtctaatattgacagtggggtgttaaattcatccactattattgtgtgggagtctatgtctctttagaggtctctgggaacttgctttatgaatctgggtgctcctatattgggtgcatatatatttaggatagttagctcttcttgttgcattgattcctttaccattatgtaatgcccttctttttattttctgatctttcttcgtttaaagtctgttttatcagagactaggattgcaacccctgctttttttttttttgctttccatttttttgggaaatcttcctgcattcctttattttgagcctctgtgtgtctttttttgggggggggcgttgggggcaccgtctcactctgtcaccgaggctggagtgcagtggctcgatcttggctcactgcaacctccgcctcccgggttcaagcaattctctgcctcagcctcctgagtagctgagattacaggcacatgccaccacacttggctaactgtcgtatttttagtagagttggggttttatcatgttgaccaggctggtcttgaactctagaccttgtgatccacccgccttggcctcccaaagtgctgggattacaggcgtgagctgtcacgcccagcctctatgtgtgtcattacatgtgtgtcattacatgggtctcctgaatacagcaccccgatgggtcttgactctttatccaatttgtcagcctgtgtctttgaattggaggatttagcccatttacatttaaggttaatattgttatgtgtgaatttgatcctggcattatgatgctagctggttattttagttgatgcagtttcttcatagtatcgatggtctttacaattcggtatgtttttgcagtggctggtatcggttttttctttccatatttagtgcttccttcagcagctcttgcaaggcaggcctggtggtgacaaaatctctcagcatttgcttgtctgtaaaggattttttttctcctttgcttatgaaccttagtttgcctgtatatgaaattcagggttgaaaattgttttctttaagaatgttgaatattggcccccactctcttctggcttgtagggtttctgcagagagatctgctgttagtctgatgtgcttcactgtgtgggtaacctgacctttctctctggatgcccttaacattttttccttcgtttcaaccttggtgaatctgacgattacgtgtcttggggttgctcttctcggggagtatctttgtggtgttctctctacttcctgaatttgaatgttggcctgtctagctaggttggggaagttctggataatatcctgaggagtgttttccaactgggttccattctccctgtcactttcaggtacaccaatcagttgtaggtttggtcttttcacatagtcccatatttcttggaggctctgttcattccttttcattctctttttctctaatcttgtcttcatgctttatttcattaagttgatcttcaatctctgatatcctttcttctgcttgatcaattcacctattgataaggtatcatgcttcacgaagttctcgtgctgtgtttttcagctccatcaggtcatctatgttcttctctaaactggttattctagttagcaattcctctaaccttttttcaaggttcttagcttccttgtattaggttagagcacgcttctttagctcggaggagtttgttatttctcaccctctgaagcctacttctgtcaattcatcaaactcattctccatccagttttgttcccttgctggtgaggagttgtaatcctttggaggagaagaggcattctggtttttggaattttcagcctttttgagctgttttttattcatttttgtggatttatctacctttggtctttgctgttggtgaccttctgatggggtttttgtgtggacatcctttttgttgatgttcatgctattcctttctgtttgttagttttccttctgtcaggctcctctgctgcacgtctgctggggtttgctggaggtccactgcagaccctgtttgccggggtatcaccagcagagaccgcaggacagcaaagattgctgtcttttccttcctctggaagcatggtttcagaggggcatctgccagatgctagccggagctctcctatatgagatgtctgtttactccctctggaaggtgtctcccagtcaggagatacggggatcgaggactcacttggggaggcagtctgtcccttagcagagctcaagtgctgtgctagaagatcttctctcttcagagctagcaggcagtaacgtttgtctgctgaagctgcgaccatagccgcccctacccccaggtgctctgtcccaggaagatgggagttttatctataaacccctgactggggctgctgcttttttttcagagattccctgcctagggtggaggaatctagagaggcagtctggctacagtggctttgccaaactgtggtggactctgcccagttcagacttcccggtggctttgtttacactgtgatgggaaaactgcctactcaagcgtcagtaatggtggacgccccttcccccaccaagctcgagcatcccaggtcagcttcagactgctgtgctggcagcaagaatttcaagccagtggatcttagcttgctgggctctgtgggggtgggatctgctgaactagaccacttggttccctggcttcagccccctttccagggaagtgaacagttctgtcttgctggcattcgaggtgccactggggtatgtaaaaaactcttgcaggtagctcggtgtcttcccaaaaggccgcccagttttgtgcttgaaacccagggccctggtggtgtaggcacctgagggaatctcctggtctgtgggtttctatgaccatgggaaaagtgtagtatctgggcgggaatgcactgtccctcagggcacaatccctgtgggcttcccttggctaggggagggagttccccaaccccttgggcttcccggatgaggcaacgctccaccctgcttcggctagccctccgtgggctgcacctactgtctaaccagtcccaatgagatgagccaggtacctcagttggaaatgctgaaatcacccgccttctacattgatctcactgggagatgtagaccggagctgttcctatttggccatcttgccagccctttctgatagattttgacatgctgaatgacaacagcattatgagccttttcttatttaaatactggcattatgccttctatgtgaggtttaatgggcttcagttacaatagagggttcctaggggcattattaacatttagaatgatgtctctaagtagtatctttgctgcttctgttaattgatggcactgttatcatgaattatggtgcaacattctaagcaacaaaataaaagttcatgcgaattttactaatttttgtttcattgatttatgaattcaagcatacaaatgttaaaacaaaaatgaaccttaggagtgccttctaaggttctaaggttagaaggtactctttctaacgtgtagttatctgacataggaaactacctttaggggaaaattattgaggggtaaaacatgaaaaatctcttctaaaaatgattaacttattaatcttgaaaatgtatacaaatgggacagcaaggttttaaaaataattcactatttttgcttgggaaaataaaagaaataaaagaaataaaatcagcattattttctttttgttagctatgatgttcagcatgatttacatgatttaaaatttgcaaaggagacaactgttggtctgcattgacttattaaaagtatttccttaagaaccaactcaggaaatcttaattagcattcaggggagtttcaacaaattttaagtttctgttgaataaatttcttccttataattctaactaattttaatattttgattttcttctgtgtgtaataatctagcaactgattactgtttagaataagcaatctgttcaatctttgtgaggaatatttacttctgtaatgataggattgttacagtcatattttttgctttatttttatttagttctgtttgcaatgcattttttcaaacattcatttgttcgttcctgttttattcatttactaagcatttacagaatgcttactgtaaaattggcattgtttttaatacttaggaaaacaatttccagcatatgttgaatgctttatatgtactactaagtgcattagttaattatcttttttaatccccacaatcatatactgggaaatagcctatttattaatgtgggccttgggtaaaaagagatgaatacattgtaatcacttttcttggtaagttcacagtctaatggagttggacccagaaaaataattaattaaaattttatgggataagtgttgtacaaaagcttgtgttcatacttggaccttcataagaaggactatctaattgtgcctgaaggagttagaaaaggtgttacagagggaatgacatttgaggtgagtcttaattgttaaatagaaatttgtccagggaatgaaggcagaaacactgcttatagcaatcatgaaatgatgaaggagcctggtatttggtggtcctggtgagtgagctgcgtggcattaaactcaggtgtttttgtgtatgtgtgtatgtaggtgtgagtgtgggactgtgtgtgtggtctgggcctggaagatgtaagaaggtaggaagggaggataatgaggctggagaggtagattcggactttatagtcaagaccctcactaagaggtttatttatttatatttttaaaagttttattttatttttaattgacacatagtaattatacatatttatggagtagaacgtgatgtttcaatacatgtatacaatatgtaatgatcaacctcaaatatttattatatctttgtggtgagaatattcaaaatcccatattctagctactttgaagtatgtaatgtattatttattgttaactacagtcaccctactgtgcaatagaactggaattcattcctcctatctaactgtaactttatactggctgaccaccctctccacatccacctgtagcctcctgcctttcccagccgctggtaaccactattctattctcaacttacatgagatcaacttttttagatttcacatatacgtgaggtcatggggtaattatttttctatgtttggcttattttacttatggtgccctccagttcatccatattgttgcaagtgacagaactgtcttgttttttaaggctgaatagtattccattgtgtatggacaccaaatttttcaatctgttcatatgttgatagacacttaggttgattctctttcttggctattgtgaataatgcttctaacaaacttggagtgcagatgtctctttgacattctgatttcattttctttggatagatacctagaagtaggattaaaggatcatatggtagttctatttttaaatttttcagaaacctccatactgtcgtctatgatagcttaactacttttcatatccactaacagtgtgtaagagttcccctttcttcacatccttgccagcatttgttatcttttgtctttttaatgatggcctttctaactggagtgagatgatgtctccttttagtttttatatgcatttccctgatgattattgatggtgagcatgttttcatgcacttgttggccacttgtatgtcttcttttgggaaatgcttcttcagatcttttgcccattttatagttggattattttattattattattttttacttttttttgctttggagctgcttgagttccttatattttctggatattaaccccttgttagatgcatagctggcaaatattttttttcccattttgccagtttgtctgttcattctgttgattgtttccctttgctgtgcagaagcttttgtgtttcatttaatccaatttgtctgtttttattttcgttgcctgtgattttgaggtcttatccaaaaaaaccttgcccagctaatgttatgttatgaagtgtttgttttcttctagtagtttcatagttttggatcttacatttatttcattgtggccagaaatgttatttgatacaatttcaatttttaaaattttgttaagacttgttttgtagtctaacatgtggtctatcctggaaaatgttccatatgctattgagaagaatgtatattctacagatgttggaatgttccataaatgtcctttaggttcatttggttagaatgcagtttaactctgatgtatctttgttgattttctgcttggatggatctgtccatcactgaaagtggggtattaaagtcttctaccgttaatgttattgcagtctatctttttctttaggtctattaacatttactttatatatttaggtgctctgatgttgggtgcatacatatttacaattttatttcctcttcctatatagacccctttatcattatacaatatatttttgttgcttttcacagtttttgacttaaagtctattttatctgcaatgaatgttgccacctctgttctttttggtttccatttgcatggaaagtctttttccatttcttcacttttaggctatgtatttacttacaggtaaagtgagtttcttgtaggcagcatgtatttaaatttattcagccactctatgttttctaattgcagaatttaatccatttatgttcaaggtaattgttgataggtaagggtgtactcctgccattttgttatttttttttccagttgttttgtagatcttttctttctttttctcttactttccttttttgtgattaggtggttttctctaatagtgtgttttgattccttgtttcttatttgtattttgttttttataggtttttactttgtggttaccgtgaggcttgcataaagcatcttacagttataacacattattttaaactgataacaacttaccttaaaaagaaaagaatcacacaaaaaaccccagtatactttaactccattccctccaatattttgaagtgttgatgtcacaatttacatctttttatgttgcctataccataattaattaatataattatttttaatagtttttcttttagtcttcatattaaagatacaagtggtttacacaccatgattacagtattagagtaaatattaaattaagtctagtttgtctgcaaagttacttttatcagtgagttttataccttcagatagtttcacacagtagcatctttttgcacattagcatcttttcacacattagcatccttttctttcagtttgagggactccctttagcatttttttttttaagaacaggtctgatagcaattaattgttcatcttggaaggtctttatctctccttcatttctgatggaaagctttggtggatacagtatttttggcagcttttctaactctagcactatgaatatatcatcccactccctttgggcctacaaggttcctcttgaggagtctgctgccagatgtattggaattcccttatatgttatttgctccttttctcttactgctttcaggatcttctctttgttttcaacctttcagagtctgatataacactaccccaagacctttcagagtcttggggtagtgttatttggtttgaatctgattggtgacctttaaaactttcctgtacctgaatattcactaaaaagttttaaatttgaggatcaatttgaatgaaaacatgagccatgcctctatataaatgaatatttagaaaatattttagaagtcatgagattaacaactttagaagaggtaagttgaaccaactgctgaatatatctgtctgatatattcttttggagtttattgtctcactttaaaaattaccaattagaaatattgtctttataaaaactagtagcaatggtaagtttattagaattaaactgtagaactgaaaagaaacatatcactgttttaaattttttaaacaacaaatatactgagtttcctgaatattatgcaactgcatgctatctagtcttgactactgagctactaatcactttgtagcttagaaatgaataaatgagtaaaccttcatttattaccttttgttttcttgagacaaagtctccctctgtcacccaggctggagtacagtggcgcaatctcagctcattgcaacctctgcttcccaggctcaagcgattctcatgccttagcctccctagtagctgggattacaagtatgcaccaccacgcccagctaactttttgtatttttagtagggaaagggtttcactatgttggccaggctggtctcgaactcctggcctcaagtgatccgcccacctcagcctcccaaagtgttgggattacaggcgtgagccaccatgcccggcgtattacctttctttctataatttgactcacagtcagttggtactgattctgccactaacctggtgggcagaaacagtgagcaatatctgacttaatattttaatgaggaacaaaaatagagtggattaactaaacagagaggaataaataaggtaatttggtctaatcctttcatccttctattaagaaatgtttctttgtattaaaacacatattcaactttattattatccatacctgtatcatttttgcagaatcacagtaaaaggccaagatgtggcagaaagagtgaattatagctcaggctgatggcataattgagactgtcagtctctcaggtaccacagaggaagtagagagtattgactactaggcagtgagagttaacatcagaataatctttctgcagtggtctcttgtgtccagagaattgggaggcgggaaggggactggacagagtttggctactggaagggcctggtaagtagcattagttaagcatagtaggagttcaaatgcacaagcgaagagggtactatcatgagattaagaaaacaggaagcttcaagattccagggagttcaatcaaaacatacaaaggttgggatgaattagagtggcttgtgatgactctctgggcactgggggcaatgagatcaccaagtgttctctaagaaaatcagtcatctgtggcatgatttcagcaagttctcaaggctagcacaacactgttcattgagtaagaggtaaactattactacgttttgaaattttaaagttgtagcacaagattttacatagaaaacatcaggctcttgttatttacattattcagatctgtaagaatagttccgtgtccaagaacttgcttccttgcttcctccacacaaatttgtataggtctacttctttctaggtatttttttaaagaaaaaattgttttcagaatgatttttatactgtttcatttaaaaagtattcaaaattatactttttatacttgctctaacaatgactccatacactggcatcattatcgttaatattttatatattaattttaattttactcattggaggtttgaagtctaatttaaaaattaaaatgttagaattgtaatttaaagcaacatttgtaaatgaaggttcaaactagccgaatgctgtaagatgttaagggatacttttcttattgcactggaattgaaaactaaaactaagggcaaagaggtatcagatgccccatattgtaaagggagcttccagtggtcaaagactcactccatttagtttaaatgcctcccgattaggccttgctttttcctgctattacccactcccatgattatggttgaagggtaggtaccctagaaagcagactccgagataaaggtaaagattagcatgcaggatattactcagggaacatttttaggataaaaacctgtgaaagaatggaaaaggaggcaaaactgagtagtgggagaagttgaactctgttgtagtctcaacaaagccctcaggtgaacctttaggaagctgagatggcccttcaaagttgtcttgagttggggcaaggcctgggcctttatatccccataagtatcagcactgggcagaggaccaagactcatatccccaagatattggatatgagccacccagggaaggggcatgatctagagtgaggcagctgttttctgctgaggtaattcttgaaggggctgccagctaaggactatctgctgtcatttgaattggtgttcctttataggaaatgttctgtttctctctggctgctttcaagcttttttttctttgtgtttagttttcagaagtttaattatagcatggattttttaaaaaatttatcttatttgtcttatcttatttggggttcacttcatgaatctgttggtctatctctttcacaaaatttgtgacattgtcagctattgtgtctttcagtactccttcagggcctactctctttctcaacttctgggatcttttggttttgtcccatgggtttctgaggctctgttcattttaggagactctgggtcctatttaaatcccttattttagtaggtagtaactctgttaggtttacatcgtaggtcctagcctactttagtgggcagtagttctaaggacaatttaattttccaagattttttggtcttattttggtgggccttgtgtatctggtgctggtggggctcccaggggtctatactgtgatgcctgaggggacagaacacatttttctaggctaggcttctttatgtttctaggtggggaaaagaaagtctctggtctgactggatgaagagtgcttccaggcctagctacttattgtggtggagattcccctccacacctccctcaccagcatctcccacccacaagtatcctggtgaaggaggggattctcaggcctggtggaaaagaaatgacttctgaggccagaagcttgttgagacaggatgcctcctgtctgtgggagatggaaagcccttcctgggctgggtgcttgtggtaagattccccagtgcctgtgctccccagccatcagtgtcccttggtgttggagaggaaagtcaggtccgtagatcatcctggcaggtgcttgttgaggcctgatgccccgtgctggtgctgtcctgtgtcttctggtaggagaggggagtctcagaccctgttgagaaggagaacatttttcctgctggttcatcagcttatcttcagtggggctcctcttcaatcccagggaggactgagcctacttgggctgccttctgttgctacattggatgtcagggaatgctggccctgggtcaccttcttccttttggtgggaggttgtaagatgccctgcaactatgctgttcctccagacctgggttctctaatcagttcaccctccttttgcacctttcagagttctcctttggttgcctctcgcattatctccagcgtttacagttgtatttagcaggagtgggtgggaggaggaaccagaaaaaacaaattatgctatcttcaccagacttcagcttcatctgagagggcagaattttgcaaaatagaatatcgtaatctctcatcaacttgtaaaaaattttaaaaaaaatcttcaacatcatgattctgatgtttaaatattatgtattataaaaataacaacatatactttatagatttatttactatagttatatctttttttaaataagatacaaggtcttgctttatcacccaggatggagttcaatggcgcaatcatagctcactgtaacctcaaactcctgggctcaagcaatattcttgtctcattctcctgagtagctaggactaataagtgcatgccaccatgcccagcaatgtatttgtttatttatttattgtagagacagagtctctctatgttgcacagactggaactcctgggctcaagcaatcctcctgcctcagcctccaaaagtgctgggattacgccaccacacctggcctatagttatataatttaatgtgactattttacttacctgtttatttccagcaatcgttccagaacagccacaaacagtgactacctgaaaaatggttgttaaataattaaattataatttgtattctttataattggcatagaggtttcagtaatttgcccaaaattatataactattgatgaaactaaggattaatattaaatacttcttttggtagacaccacatctattgcatctggaataccatatgcaaattctcttattacctattgctgcatctgttttatttctggtctttagaagtctcagagtgacattagaattacaactagttttagtaagtattatttagttatcctgagagatttgttaaataataataatttttaaaagcctctgtagtcagtaatcagcttctcaccaatgataatacttctgtctgagattaatatcagtgcttttcaatgcagcagactaaaactaatctctattatagaatccacagctggcctgatggaactgtaatacaaaagtaattggtattttttgatgtccagaggatgcaaattataatttgtctcctgtgtacagaaaaaaagtgtgtcttgtatggtaaataattaaacttgatactcataaagttatatttttccatgtcttaaaggagatgactattttatacttacagtcgatataaatataataatgtatttatttcatccttgaacaatgtaactaacattttactatatattaatagaagccaactacaatttgaaattaaataattagacttatttaggaaagaaaaattatggttttttatttgctacttcaggttatgatgaagattctctatttgattgtcctaaagtcaagaatgaggagtgctaacgatagaaaacttaggacaaatgaaaacatatattttactttcattttgtgtattttgcaataagcatataaaatcttaggttagccagtttgcatttatttgatgaaagccaaactttaatgtagtatttattattgttttcataaatctaaatttagctcaagtctttcagcattgataattaagaaatatatgccctctttaatagcgatgtatgtttaattgttcatattacctgaagtcatactgagaattttcatctttttaaatgtcaaaatttggctaaggttatcaggatattaaatgtaatatttcaaaggagtatgatctcttatagataattccagattttgtgagatcaaaattgctgattataataatgttagtaaataatatgggaaaggtatggcgaaatatttaaatttttacaattttaagttgtatgatgtatgtaaatgctattttttctggtaactttggtttaaaaaccagtaatactgcctttgacattggtgttaactggatacattgctttttgtgggcattggatatccatctattttgaaataatttgggagaaataaaataattccttaagatatagtctagcatactaaaaagaacatttgtttgatgttgggtgaaaggactcaagcattggattgaatagttacttaccagcccatgaccttgggcaaataacttaacctcactatagcctcagtttcatcatttgttataggaaaagtaaaattcccaatttgcaagattatttggaggattaagatatcataaagatcaaatcttaaacattgcctgatacataatagatgcttagaaaattgtcttcaggatctatttgtatattccattatttggttgttattttgggcatattttctaccttgataagcttactaaagtatgtatcagctggtccactggcttggtgattcagagcataactttctaatggaaatgaatcatacaagagctcattttatgatttttataagctggtcacgtcatgagttagatttgtgcaagaagttagttcgaacttcttgatgatccaagcattgcgttagggtgaatgcagagccaggtcagcttctgcatgagccagcatactttagatgtgtaacaagactttaacaaactggaagaagaatattgctttaaaatgatgtgtccagattggaaaaagaagaaatggaaacatatgttccattgaattttcattaatttattgtaagtagaattggcactactagagaaagtcttcatatactacagtagtttaaaaaagagaaatacagaaacagggattatataatttccactttattccttactctatattccttactatattacttacactttattcctttctctataagctggccacgtcatgagttagatttgtgcaagaagttagttcaaatttcttgatgatccaagcattgcattagggtgaatgcagagccaggtcagcttctgcatgagccagcatactttagatgtgtaacaagactttaacaaactggaagaagaatattgctttaaaatgatgtgtgtagattggaaaaagaagaaaaggaaacatacgttccattgaattttcattaatttattgtaagtagaactggcactactagagaaagtcttcatatgctacagtagtttaaaaaagagaaatacagaaacagggattatataatttccacttcattccttactctgacttttttgtgggttggagggtatggaacttggcttctcttatgggaggtgcttaagagtgtgaactttctagtaacattacatggcttcaaatactggtgccagcctttggtctcgaacatgttacttaacctctccgtgttccaattttttaacatataaagtggaaatagaaaatggtacctacttcattagcttctttgggggactgaattagctagtaatacgcctggcatctaacaaaaatgataaatgtaagctatgttattttttagttaggattcggggtataaatgtaaatttgagtaattatctggtgattacttttagccattgcattccatttctctttagccttccattacacttgtacaaaagcagtgggtgcctagtacaatgtttggcatacatgaagcgtcttaatggttggttttagatgaatggaagcagaaagcttagaattatcatggggacatgatatttagccttgaaattcttattgagctgaagtattcttacctatctttgtgggttttttgatagattttccatatctttctagtaagttaatatcttctcaagttttttatttttatttttatttttttttgagacggagtttcgctcctgttgcccaggctggagtgcaatggggcgatcttggctcaccgcaacctccacctcccaggttcaagcgattctcctgcctcagcctccctagtagctgggattacaggcatgtgccgccacgcctggcttattttgtatttttagtagagacagggtttctccatgttggtcacactggtctcgaactcccgacctcaggtgatccacccgccttggcctcccaaagtgctgagattacaggtgggagccaccatgcccagcctatcttctcaagtttttaaaccttaagcttctaaagtatactttaaattttcaagaaatttaattagaaagtagtggaaaatttcttactctaatcttttctagccaagtttttcctttgcatttaagttcaagacctgtcatgctttgtgtctaacaaacatgaaaagaaagtggttaaagagacttacctttagttgagatagttttactatttttacattaaaagaagaccattaaaaagtttatatatttgatatctgtcagaaattgaaactaaatatcttttcatgtataggtgaaaatgtttcattgatgtagtttacatttacatcagaagcaccccattgaactgaaatctcatctaacataccaaaacatttgattcagattatttacaaacatagaataatactgatgatttaggtgttctccaagctatacttatgcatgctaaatttcagctaattttgacttattttaataaacatattttaatatgcattttaaaatagttattaaactcttaaattttaaaagtacatatgtccttttacccataatactttggagaatttttttttaatttttaatttttgtgggtacatagtagatgtgtgtgtatatatatagaagtacatgagattatttgatacaggcatgcagtgtgtaataatcccatcagggtaaatggggtatccatcacctcaaacatttagcctttgtgttacaaacaatctaattatactcttttagttatttttaaatatacaactaaattattatttactatagtcaccctgttgtgctatcaaatattagttcttactcattctttctattgtttttacccattaactatccccacttcctctccacccctcgaataccctttccagtgtctggtaaccacccttcttttctccatgtccatgagttcaattattttaatttttagctcccacaaataagtgagaacatgcaaaatttgtctttctgtgcctggcttatttcccttaacataatgatctccagttccatccttgttgttgcaaataacagattctcattctttattctgacggaatactactccattgtgtagctgtaccatgttttctttatccattcatctgttgatggatgcttaggttgcttccaaatcttggctattgtgaatagtgctgcaacaaatacaaaagtgcagatatctctttgaaatactgattttctttctttggggtatacctaggggtgtgattgctatcttttgggtataatgtaggagtggggttgctggatcatatggtagctctgtttttgtttttttttgtgaaatctctaaactgttttccctagtggttgtacaatttacattcccaccaacagtatataaggatcccctttttaaagaacttattttatagaagccccagtatgtggatacacacacacatacacagacacacacacacaaacacacaaatttttactagaacattatctctaacagcaaaactggaaacaatgtaagtgcccatcagtaatgggagtagttttactcaaactttggaatctcatagggcgttacatattatttcattagttagagtcatggtatattgataaaagagaaatttatgttgcgtggcaaatttatttttgtcataacctcagaagccttaactatttgcatatatttataagaacatggaggccaggcgtggtggctcacgcctgtaatcccagcactttgggaggctgaggcgggcgaatcacgaggtcgggaaatcaggatcatcctggctaacacggtgaaaccccgtctctactaaaaatacaaaaaattagccgggcgtggtggcaggcacctgtagtcccagctacttgggaggctgaggcaggagaatgacgtgaacccaggaggcggagcttgcagtgagccgagatcgtgccacttgcactccagcctgggcaacagagcaagactccgtctcaaaaaaaaaaaaaaaaaaaaaagaccatggagaaaagtatggaagggaatggtagataagaggagttgagtttgtttaatatacttgattctttaacatgttcaaatgagtatgtattattttatattttatataaatataatttattatacttacatgttttatgttttttcattaacaaagtaaacactctgctatattgatcattcttcaaatggaaacagaagaacaggggccatccttatgaccatctgcactaagagagttagcctctgaaggaatgtgagatttaggctagccatcatcagtgaccagtctgtttaaaacatacctgttcaatcaggtcccagcgggaaacagatgatgcagtcaaattacgataattcaagagctggagccaggtgtagtgtaggagaaactcaaggagtttttcatggaccaggggccaccaacagcacagctgttgccacttgaggcacaaagagacaaggagagggggaggatgtcagaacccagaaaaagtcatgttgtaaagaaccttgattagaatggtgaccttctttcaagggacatagtccattcacggtaagcttacaggaagtgaaccagggaagaaaatgttgaatgcattctaatctctcctgtcatctgccagggctccccactgactgaacccaactagagacagatgttaagagagagccttttgatgtcaagtacctagatcagcagccttgggcagagaacaagggcaagtatagagaatgggttttgaggagtaaacaggagctatctggcataaaatagccaactttttattttattttttttttttgagacagagtttcattcttgtcgcccaggctggagtgcagtggcgtgatctcggcccaccgcaacctccacctcctgggttcaaacaatctcatgcctcagcctcctgagtagctgggattacaggcgtgtgccaccacacaaggctaatttttgtatttttagtagagacggggtttcaccatgttagccagggtggtctcaaactcctggcctcaggtgatctgcccaccttggcctcccaaagtgctgggattataggtatgagacaccatgcccagccccaatattctttttgaattaaataatcaaaataacccagaagaggaaaacatagataatatgcaaaatattgatatccatttactttatgggcttacataattattttttaattgacctaagcccaaacacaaaattaaaaaagaaaatctgaagatggcattgttcctcaccctcttctgtacataagtcctaagttcttccttaaactcccatgagggcatagcagtgaacatctcagagtggggacagaaaactattcctaaagatgaacatggccccagacccacaaaacgccagactttggacttggtctgaaatagtggaggttttctgttaagtcctagcttgtttccaaggaatgacactgtaaatcaggtcatggaatgggaagctgacatttactgacccttggcatgtgccaggctccatgacatacattcatgtaagttatcacttttactcctctcagcaaacctgtactgtgaccaatatggtcacatgaatgtatgccatggagcctggcacatgtcaggtttgctgagaggagtaaaagtgattactctttaagaaacagaaactccaagagtttaatttggagtttaaggaactttctcaaggtcaatgatagagtctggaattggagctaggtctgcttggctacatcgtggcacagcctcacttggctgcaagatggtaaaggagtcattatctattatcagaggtctctcacctgtcccagaaatatggctttccccttcccctctctctcattcccttatcttccattcattcccttagttatatatttaacaagtatttattcagtacctactgtgtcaggaatcatgcattgtaccattgatatcaatgaatatggcctctgccttcatggattttacagcttaataagaattctcaggggattcatcgtatggatttccactagccccaagtccttttcatttgaggtcatttgcatctcagtcttcctatatctttattaagactgagaattattttttggcctatttgtttaaataaaagtgtaatataaaaattgtaataaacctttttaaaaatctcacttgctagttcattattttagagaattgaggatactataatattataagaaatatgaaatactggaactaggtaagataatatttttaaaggtgctttctggttttattgaaacaaatcagccagctcccccaaaaatgtggatatatgggtacatgttgaggcttatgttttaatcaggctaaaagcgtatcacattctctcaaataagcatatctttcatttcttaaattgaaaatttatttgtatttattcaaaacctttcttgtcaaagacaagttaaaactgctgttcaagtgtcttgtataattataaccataaaactaataaacatttcaactaattttttccctattcagatatgcttgttcactcttgggaaagccccagattgggttactgaagtaatctcatttttgtaactgagccagtattatcattatcaaaattacaattgatctacagtatagtgtcataaagggtgactggtatgtagcacattctgatttctctcattttgcattagatgcattgcataatagaactgtaggaattgcctgctaatgctttagttcaccctttaacaattaagttaggcaatcttgggtaaagcaacattcagtaggctccatgcatgttgttttctataaccacctttggatgcaattttggggagtgggagggctgcaatacacacacagagacacatacatatatttataatttgttaagaggaagttactattaaacatctaagttgacatattgtatggtgggttcttctgggtctgatcctagacaagtgagttaacaacatctttgatcctctttagctttctacttttgtaaaataaaggggttggaccaaataagtggggtttttgtttgtttgtttatttgtttagcttttagagttttttttgcccatgctacgatattcctagaagtcactgagtacctagtaaggcaaaccaggaccagctgtagctcctcccttgtactttaacaacagtaattctgttttgttttatatgtgaatcatcccaagtaagacttccaatctctgatgccttttcacctatttattagtagtaggggtcattgtattctatttttggcttcatagtgaatgacagcttgtacaaacaacacagatactggaataatcagtcttttcttcaaattctgtagtagcatgaactgtaaagtattaatcatgtgtttatgcctggtttctacatgtgaatccgttaagcctattcttaattttctcgcttcgtcagcttcaaagcaggaaattacaccattgcccaaaatctccaccattctgttgattttgtttgggaggtgtaaatctagtaaagcatagacagaggcctgttgccagattgatagctgtatttgtctgcgtagattgtattttcacagctgtcaggtgagatggttgcttcctatataaagtggttctagaatcatgcatgtgcttgggattttaatttatcagattttttagcacttcctacttaaagagcttcaaactctagggaatataatgtatgccattctgaaaggtggtatttcagcttttgtatctttggggataacatgttgtgaatgaaattggtgttttaaatagagctcctggggaagtttttgccaacagtccttttgatatcccatgtgctctattgtaataagaaagcagaataaataaactaaactaggtggtcaggattctgttaggatgaaaacaagtataatttcctttataatgatgaaaagcaaacaaaactctgtacgaatagttttaatcaatgtttaaagactggtttcccagactcttgtgtgtttgacagatagtcttgggtggggtagaaatggagtggaaaaacaaacaattactgtggagataataaaaattactgggcaaaaagaaaaaaaatatttgaaatacttcttttttttttttttttaaaagacagagtcttgctctgttgtccaggctggagtgcagtggcacaatctcggctcactgccacctctgcctcccaggttcaagtgactctcctgcctcagcctcccggctcatggttgacataagttacctctcccagcatttttcatttgtattttgagaaaaacataaattaatgtgttattgaaaactgccgtgatcatttttcatttaggctaattattccaggaaagggattcctatattgtattcactttttttggttttaatactttaatagtgagtatttatagctatagaaatttgatacttttaattaaaaaatttgaaactaggttcaaatgaaagaaaaaattcttataaactttaaaaatgtaaccacttgtttagggtattggaaatcaattctccatatttgacactatcaaattagcttcagataacccttttcttcattttgtgttcatgttgttttcactttgtaaacagtaaaactccatctccttgcgtgaagttattttagggggaagaaaaagtgcaatacacagattcattatcttgtaatgactcattttagttttgcattgaatcaatctttgagacaattactgtaacttgattttttccttccctccactggtaataaaagagacattttatttcagggaaatgtgaagtaaaatagtcttgcttcataagcatgctcagagaagagatttttaaatcttgttttaaaaatagtggcatcatgttcatgaacttcaagttttctttgttccttttcttcttttcctttttctgtgaaactcaaggattaataggaagcatgtccaaaattccctctaggaagaaatttagatagggacataaatatattttaggcattcttactaagcatttccaaataagctttaagagtttcttaagtaatctttgattttataggaagaaaaagggtcaaagtttgctttcttcacaaacttcagtaaacaaatccctcttgtattaatgaagaaattgactaaacctaccaattatctcactattataaaacatgtcttgaaaatttattagatgcaggccaaaccattgaactcagaccttgcctttaagaagcttccatctaattaggatatatctcaatctattggagataatgaagtagaaactaaattattattaattttagacacacaaaagtcatttcacttctgtaaaatggaagaagtaacgtgaagctacctgactaatgaatgttggataaccagttattggagtgctttgtggaggtaaagtaataactacaaataacaataaagtttcacctttacttgcgtatttttatgtcacttttgctgaagaaaagtgccttgacatttttactagtaaagttaacttttttgttattttttagagaatagaaatggataaaatagacaaatttgatggattctttggaaaaatcattattggatttatagttatcggaacgtttttgaatatgatcaaacagtttaaattaagattctattacatggatagtaatacacatggaattaccttaaaagtgattgtgtactatgtagaatatcacaattttgtaaaatagttctatagcgaagttaaaatattactggatatgcttatgtaaaatacatgaacacacagttgacataaactaacttgatgattggccagaactggaattccaattcttacacctacccatccacccacatctattggacaagtgcctggttaaacagatgggccttgggctgtgctctcaaaacaggcaacctccacctttattgagcaaaacattggatgaaaatagactatattgtcttattgtgctactgaacatggtaatttaagtgaagagctcctatttattattgttgttggttgttaaaaatacctttttccttatgaatgaatatgtgaaaattggaggacaacagatggagtcccagggaactggaaaacctatagatagggaggtaattctcagtcaaatatgaaaataaaaaatcagcaggagtgtgaaatttcatgtggttttataaatgcatgtagctaagattttagaaaatgtttggtttagcctacagacatgggttcatcatgaaatttctcttttccactaaagggtatgagaccaagtagaattctcgaagtctgtcctcatgccccttcaataagttaccacttcaaaagctacaaagctggattcagggcaggaccttaagttctggctaccgtctgtgtaaatatcacacacttacatgtggtaaagtcagagggacttgcagacctgagtgatacttatgacatcagaagtgagttttgtttatggttgattaatgacattgctacttgggccatgtttgtgacaacagcactgagggcaattagcaagagcaacagttagacagtcccatacttggaagattatatgagactaaatttgacactcttaatattgacatctcgtaaatagcatttggtctctatgtattttcatgatattctctttaatgtaacaacaatcagtaaactgtcacatatctaacctcatggaactcacatatctaacctcattgaatcattaacaatgatatttgcacctcttaaattatgaaatgggtggtctgtgggcagcatgctaaaattcaagtaaaagacttcctactcctttttcctaaattatttttttagtcttttggtaactcagttttcacaaagaaggggagtttggttgctacctactttccctgtaatactgcttggctatttttcagtggcaagaaataattcctgtgatacttaagaactctatggaataaagctcagtatagtgtatattgaattatgctttctggttattatatttggataaatttaggcataaggttgtttaatacttcagcagaaacctgcaatggaacttcctaaaaatttgaccttgtgaaagaaatccaaatggaattgttttatatttttttagctcctataaatgtgtgtgcggggttaataaataaataggtaagaaatagcacagcattgtttaacgtttatttctttcctcaaaataaaaagttaatagaaaaagtaatacattgttattatttaagagttatttcttactgcaaaatgttttgtgatagctttgtttcattgtgtttaacttaatttaaattactataatacttttttgttacatcgtcctttgaaatcattgaaattgactaaataatattgttctattctacttgataaaatggagagctcagaagattaatttagatacagaattgagaataaaacagtctcaatttgtgcttaattttattagaaggaaatatattataaaaatagccatttgaagagaaaaaagataaaagtagtgaaatattttaattttcaaactctcataaaatagtaatacaggctgtctttaaatgaaagtaaatattttgtgtttatgtatgtatatgagacatatgatcattattagctttatcttgaattactctgatatactatatttcttatacatattatttaatgtcttttgttgtgttttgttttaaacagcaaatgccagtcttcttggaggaggaggtggtaagtcctgaacatcacttaacttaaaatacattttaattgttataccaactacaagatatttagtaagttctgtgacacttaaaagaaaattaattttgctgtagtcatcaattacaaaaatgttaatctttcaaaaataatttataatataaataccttggtttgcttaaatgttattttaattgacttcgagatatatacagtactcttgtcaaactttgtatttctgcttttggcataaggtgtaacagctataagctatatgaacacacatgtaatacatgtgtgtgcatagttacagagtaactatgtacatattacagagttacttttaatatgaattctaaaacaacagaacatttggaggctatggtttctttttccactataatgactttcttttgcttttcatgactttgtagcctgagagcttaatatatcagccacttactttgaaaaataaaaaagaaattactgttgacactctgctttttctttctgctcagttagaggagaaagagaaggagatcaaagtgagctgagggagacagagattcctgtactgggaatttttttgatactaaaatcttgtaactatttgtatttttacttctaggttaggaagatgaaagctttcatagtcccagtatatataatatagtaggagagaaaaaagtatacgattagaacagagtccttttcatataaggcccagatggacataactaggtttgtttcctctttccctgtcactctctttctcccttcctttcttgctctttcttttttcttacacacagttgaaacagataggattgtgcagagccttaggctttcatcaggaggtttcattgtaatttttatttggaaattaagcatttaacctttgtttctctgtaagaacagttgatttttaaaaaacagaatcttgaaaataagaaaaatagaaaagtgtttgaactaggaagtgctcttcgtattatcacatgtcagtgcatgttctgtaccagagtatcatgaaatgagtgtgggatttgaaattggacttactgtgtggagaccaggaaagcattactaaatatctccaagcctcagttacctcatctttaaagtatgaggataatattaactatctaaagtgtttattgggagaattaaacaaaaatatttgccaagtaactaagtaatagaacagtgggggattcataaatgtctatttcttttcttctttcctaagttattttagaaaatatgaatttgtaggatgtttcattgcacttgttattttatttggggggaactagaagggaaaattttccttagaagttgaatttccagtaattttttctctctgtctcttgtaataggtgaagaaaacatgattaagttaaattgtccatagtgctgattttcttacaagatatattagtattttaagaaacctcacgaatattgttaatagcatagaggaaagttaaaattgagtctatgtaaacacattcatcaacttaaaacaacaaattaggtagacgattcagttattgcttttgagtatttcaaaaaattgacttgactaattatattagttaaaatcactttagccactataacagaaaaagtaaaaaacattaaaatccacaataacagtagtttaaaggagatataaatgtatttctgtctcatgtaaaggtagtctagatacaggctggaatggttgtgtgatgaatcagagactcagctcttacttttctgttctttcctagtgcatggctttcatacttagatgacctcagggtacaggatggctgctggagctctagccatcacaaatatggcacaggtcaggagaaataggaaaggcaaaacatgaaaaaaagtgggctcccaaacatgagtcagttttctttaagcagatttccctggaatcccacattgtctttgaatctggacagtattcattcctagcatgtagtcttttattccaagaagcaatgcactcatcagaaaaaattaccgttctgttcactaaggaggaaggggagaatggaggttgaggaaaacagtgtaatgtacctgccatggtggttacctctatattgtcaaactgatttctttaaatatatgtatgtattgttggtgtgtatagaactgactccagtgatttggcttgtattttcttatgattcctctcttctctgtgagaagatttatgaatttctagcaatgataagacattcaggaataggccaactcagttttctatttagctaaagtctttattttagtgacttcctctagatggttgattttgctcaatttgtcacgatttataatttttgaataataaaattagcaactcagcatcatcataaagataaattacaagtatttaagatggttgtaatttctttcattaaagtaggtcatcgacaggtttaaatttatttatgcacttctggagatgtcaagattgctctaaaacacgtgtctgatttttggaaagctgcatttaaaaattaaatttaaggaatatttttagccttctctgagctgatttttgaccttatgattctatgacaaatctttttaatcctctcagtgatatttgtaaagtaacagctagtaatcatctaataagaagcgattgaattgatgtaattctcttggatttaatcaaacaattccttttttcaacatgaattaaaatcccttcaaaggtccatcaagagaataattttttaattgactaaacaatttgatcaagaaaatttgacaccacatacaaaaataataatgggacctaagtccccttctttagatcctcaggagggcttcccccatattctatatgagtagtacctgatagtgaaatgtagacaaaattattgtatgcaaaattgtattagccataaaatcttagcattttgttgttcttttctgagtgcttaccaccaataagactgatcccctgaaagacttaaaaaatggtcacatatcatcctctcagtgctgattttaaagtgagagatttactttacattgatgtgaattttcatctttgagctagatatcaatctttctatgaatgtattgccactgactgcagttcattgtagtgagcataggtgatgtgattacttctactcagtcatttcagttaaaatttgataacttttaccaattttaccaatttgcttggtaaaattgatcacttctgttcatagtttctagataggttgaaggcagagacagttatgtactaatttcttaatatatagctggtctatagtgactgaattgtacttttcaggaggcatttatattaatgttaaaaatctttgaagttccgttaatttttttgacaaactttccattattattaccaacagtaccctgtatattattttacctgttgttattttaatggttgagagaaacttcttcaaagttgcatagcttatagggcaaagttggaatgagaagacagcgttcttgactgccactccagggctccttgccctggcactgtggtttttaacatgcctctgctctccaggtttgcttttctatgcagagatgggtaattctgtttacaccaggaaaaataagtgagaggacaggaaaacatacagttaagatacggatgttgcattccttggcttattttcacaagtctcaagatctactgatagcttgaaagtcgatacaatggcactgtcttacagtactcttggattgctgcccagattcatatacttttttgtgcatttgagattcagtcttagaaaacactgcatttcagatacatgttcacccatctgtaataagaatgttgtacatgcacaaggtcctgtgatgctggtacttttggaatatatagtaaaatataaatcattgtagccagtcttaaattacataaagaagtagaattagaaagaaaaatcagaactgaagagctaattcctcacttccttttggatcattatataataggaacaaaatttacggtctcttactttagataatatcttttgtttttcattgacgtaatagttaacacaaaactagaacctgctgatagaacccaagcaggatgttgtttatgggatgtgcttcctcctccagtctgtcaaagcacttgagggataatgctagacatttaaaatgacggttcctgacagagtggtaacttactgtcttttgtacacatagctttatgactgccattttaatcatatatacatacacagagataaaaaataaatatatatatttgcatcaatgctgtaatttgataccttattcctgagttgattctgtggcaggttaatagataagtactgttgtctaataagcaagtgctgttatctatgcagtcagccccagctgcaatgcatgcaaagccatttgtccaacgcgagaacagagaggacactgtgagccttcccacctctgatggcttcctgctctccttctgccccttagagtaggcccaaagatggacaaggttcagtgccttgtgttagtacctgctcctctaatctccctcatttctgatttggacagttctacttgcagagaggattcattatgcttgtctgttattaatgtcccttcatacaatgaggctgtttgtgtgacatactaaaattcatgcttgaaaaggaataaaattataacctgggtgataggtgataggtgcaccaaaatctcagcctttgccattacacaattcatccatgtaaccataaaacacttgtacaccaaaagctattgaaataaaaaaaaagaaaaaaagaagagtgaaatcataaaccatgtgctgttatatcatagatagtatttgtgcatctccacacacccatcatctgtttctaaacacaagcacacatatgtgcatacattcattcagcaaatattaattgagttactattgtttgtcagtattgattattgattgggcagtaaacacagccttttccctgtggccaatcatgatccctgttcagctgaattactagagcaattatagttgtctacattctttcagatgttccaaggattctgctggcatagtcttttgagttaaaatgatgctttaacattaatagaatgggcattggatgtcttctttaaaaggcagagcagatatcctgaaaacaactaatttcacaaaaaatctgagttgctacctggaattcctaatgtgaagagcaatgtgtttaaagggctttttgagtgtgtttaagagggaatgatttcataaattttgtcttaagcattcacaagcagagtggagcgccctctcacctccctccacatacacaacggctttcccagcatatatcactccagcgctcaacatcctgcagtgattctgtttcgctcttgttaaacctccagatgtggctgggcttcaggcatgctgggaggaatctaggatagcagtcagcagggagggactgaggcagtttacagagggtagagtgttgggggttacccctcaggagagtcagtcaagcatggctagtagtgactttgccagctggcctgtgctcagcaggggaggggccccagccatgggcctggggaacagcaacagcctttcagtcctgagagagcagcatggcaggagaaactcaggggctctggcctttttactcaggcagggagcagagatgcaggaaaggatgtgatgctaggccacagaaaatagggtttaaatcttaactgcctcggccaggcacggtggctcatgcctgtaatttcagtacttcgggaggccagggtaggaggattatttgagaccaggagtttgagaccagcttgggcaacatactgacacctcatctctacaaaaaataatcaaaaattagccaggtgaggttgtgcatgcctgtggtcccagctacttggaagactgaggtgggaggatcgcttgagctctggacgttgaggctgcagtgagccgtgatcacaccactgcactccagcctggccatcagagtgagaccctgtctcttaaaaaaaaaatcctgactgccttaggtgggattgatcctgggcactgtgggcggataagcctgctaaaggaggccaggaggcccagatatgaggaagaagagggaaggtggttagggaccaggagccaggccaggtctgacaatgctgagttacacactgagccaacctacctttgccctccctccttccctcctccccgtcttctgtcctccctccctcctgcctcccttccttctttgctttcttccttcctttccctgtttccctccttccttccttcttttctttttgtctttctcagtcaacagcaactattgattacttcttgtatactagccttgaaatcagtgtaggtaagattcttagaactaagtgcagccagaggcataagtacttatttacacattaatattttaagaactaaataggttcttcaagcagggaaaatgaaacagaacaaaggaagtcaacagcttatagtggtcagggaaggcttcccagaagaggtgacatgggagcagtcttgaatgatgagtagtagttttcaggaagcagaaggtcatgatctattcagatgtatttcctactctttgctgtagagatcttgctctgccatctcctcactgttctgccatcatatcatccaggtcttggttaagctgttttctttgacagtcccagcatgccacttaaaatggagtgaaaagtgttagggcagaactgaagagaggaactctggtgctggtgatgtgggtagcaaacctccatcagagcaacctgggcaaagtctggtggtcatcgccagtgcgagctcctccccgctttactttctcttgtgattacctcacctgcttctcagtctagggaccatctctacagctgctcactccagttggatttctagtatgtgttttcttcattccacatgaacttgtctagttctttctcttaaaagtttaacttagccctgattgctctaatcttgcctgctttttgtcattaagccttccagatgctcttcgtggtagaggaaggtgaggtggggagggttcaaaatccaagccatgcatctgccttgaactcttctattgtaatggcaattccaaggacataatttgtttattacacttctaactttggttactgtgatcccttcattctaaaactaaacttcaaagttattcatcatgtttactacacatgctcccacttctaagtgaacctccctgttgaaagggcaaccctatgcagattaaatgctccttctcattgtagccatacctgaacctggaagtgtgtattccccaattaaggcagaaatttcctgagagtgagtaatttcatattcatctttatagccctggcttattctatcacatatagtaggtgctttgagatattactgtctctcatcccggattctcaacatgtttatatagttcggttttgaccagtttactttggaaagttaatctctttatcttcaagtgatttctaaatgaaaaaaaaaaacaaaaacccaaacttcagaaatgcttttaacaggcaacctgaggattatattcatatttatacagtaattatttttatcatagtattatcttttatttttaaaaagtttgtatagccaggatctcataattttctttaaatatatttactttaaatgggcaataaagagaacaatatgtaattgaatagatggggaatgaaatacagagaatttacattctacagatcacatggaaagagggaaagcctattgtttcattcatgttttaccatattgagggtatttaaccagttatatcattctcctttttcatagtttgattttaatttattaataatttgtcttttacatactacaggtaacttgtcattgacatcatattactaatatgtatactagtgttatcctacaatacgtttctatttttttttttagcttcaataatatagaaaaattgtatgtgttggtgttcttaactggatactcttttaaggtcacttgtttccattttacttttgatttttagagtttgcgtttttaaaatgagttttataattggtatgtattatttatatttgtatgtttcataattaactctttttaaaaaaatagaggtttagtcattctttcagaaaatgttgagattagcaaatcatgctcaaagataggaattaaaggttgtaaagaaaaagaaataaaaataatggaagccctcttttcagatgtggaaatacgttggtaaaaattctaggctcttataagttctctcactgtgttgggctagctaaatgatacctaaatggttggaagttcagataatatctataaacaaatattttaaagttaggaagtactctaacaggtgccaggatatgtctacatatcttcctaattacatagtagctatagtataatgcttgtgtagcttatctacttgcgttaaaggtaaaatctttttaaaactataaaaaagagaagtttattgagttcccgatttaaatatctctcatccccaaagaatctctgaatgtgacttgttggtacacagtaggaaacaagtttcaagcaaaatactgcaggtcaagcctgttatgttttgggatgactacattatattccttcagtttatggcacagaattgtttttttaactgtatctgatgtagctccacagtaatacaaggtggggcaatttcttagggagccacttttataatcttttttgtttttggcactgttaagaatcctcttcttcatttacccctcaaactgaagatactgtagggatgaatgaatctggccagttcttgatggcaacaaattcaagatctccagggtcctgtcacaggcactgtgggtccctcgggttacatgatcccttattgctgcagctctctttggtcaaaagtcattatttttttaatgagttaggacaaatttattgttttgtatactagtttcctgttctaaaatgatggttataatggtacctaactactttacaggtgtggaataactaattgcccactgtaaaatgttgttgaactacaaagtgttagataaatgagtatcactctacttgtcattattattaatattatagtgcaaatctgaaagatgaaagttgctggataattgcaagatatggtgatggtgtatccaaataaaggggaataacctgaattgttggataacacaaatccagatatctgtgtgtagtagaagagtttgttttacaaaaagattatatagatagctgtgctttaattaacccctcaaaaatctgaggatttttcctacaaatatggatagaggaatattctaacagtagttcatttcatcggtatgtatagtggtcatcataaggaagcgtctttcaagtatttaattgcccagagtaaaaaataattatatactagagtatgaggaattccagcttcatgcaacattaccagtctaggagaaggtgagcttaatgtagtcttcaggacaggacacgtgatgaggccatctcttaaggtatgtgaaaagaagccagaagcagtagcatttttctattcaggcacatgcttggcactggggaggaacaagggatcccacagaatagagttaatggcccacccatgtgtatgtccagcaggcagtcaggcctggaaaaagaagtagggaaagaaaaacctagcagaagcttagagtacacaagggaagggtggtgctgcaatctggaaggtgacagggaagaccaggtatcctcatggggacacctgaccctgagtttaaatggcagcaggagagacctggcaatagtctggagccctctgaggtcagtatatagaccccaggtctgaaagggtgacccaagtcagattagctaagagaaggttgaggctgctagagaatctgagtctccaaaactggctttgagagtggggctgaatggagcttatgcatggggagaatcagtggattcagctatgaacaactgggagagagatgcaagaagactcagaagtgtacaatattgggacgttctccaggagaagatgaacaagaagtgatgtctgaggagttgtagctaaaatactctctcagcttctgccacatggttatttctgaccaacaaaaagctctcagaaatagccatgaggggcacaaagccctcactaggctaaaaatccactaactctgcaacttcctagatgctgaacacaccaaaggcctcacacttacaaatgtggtatgatgtccatgcctgcagggtcagctttgcagaacagaccaaaaagacttttacaaagctccaggtttcatttctagcatgattggaaaaagcataattttctagtcagattttgttaaacaaggaataattctacatctccattagtacaaaagccttgctctgtcattagattatctctacttaagaatcttctagcaggcctctctgcatgccctggatggttgggcactatccctactgtgtctccatcaaagtcagtgcattttcttaggtaactatctctctttcctctaagattatagatttcacaatgacatggactgtttctattgtgttcacttgctgaaacctcagaatcttgtagaaaatttgacatataataggcacctaccaactagctgttggacagatggctaaagaaataatggtaataactaacgtttatggggtgctgatctgtgccaggcactgtgtaagaattgcacatacattatctatgttaattatctcaatattctgagtagatagatattattattcttctcattttacagatggaagatcaaaagctcagtgaggttaggatgaataaaatattgggcagacccagtatttaagcaaagactctctccaactccaaatcccccttttaatcattgtactgtaagttcacgagttcaaattaacttagtattacttatgggaataaggagtatattcatggatttatatgtctctaaaccttcttattctgattttttctgggcaacagattttcttctttgaatttccaactcatccttatgtctaattctcatcctctggaaatagctttacccctcagagttatttcctgggaatagaagaatcagtggtgctaagctaggaatttctaggcttgtctctccttctttctcagtttgaatatgatacagtatccgttatttaaccttaattctgataaaatagtattttcaataatcagaaattctgaggatcttgttgtatttataaataacagaaataaactataaagaagtcctctttgacttttctcaattccatttttctttcacacagacaatcattattcggtgtacaactttttatttgtcatagttttatatacatatgtatctgcaaataacaggcaatattgtttaaaaatgttgcataaatatattatgggcattctaaaatttgtttttattttattattttgctaagcattgtttaaaaatgtattcatgtagatatagaaaccactaattacaaaatgattactctaaggatactttcagtttaattgagaatggctttatgcctataaaattcagttctgtttttgaaaagtagcttttaggaacatatgtaccagttatacaagaatatatcttcatagtcctggtacagctagtctttctaatgaagatgataaaagttggaaaatttgaagtatgtacagtatatagctttggaaggcagcagcagtactaaatttcaactcccacaagtttagatgtgccagggtagtatatctggataatatttagattggtgctcttaaatctgtctagtgtttctttgcatatatcaaggaatacctgtttttggcctaaaaattttatgccaatctttatacccaaacgccaatggttaattcatcctttaaaaaataatacaagataactttgataaaacacctagaaagttcttatgtttgtctcttttcccttgaacagggagaagaactctattacaagtattatcttaaatatactctgaattagtggttctaaaatttgaatatgcatcagaattgcttggagggcttgttaaaacacagattactgggccttatgcccagaatttctgttttagtaagtctgaggtgaagtccatgaatttgcatttctaacaagttccgttttaatgctgaccctgccaatctggggaccacactttaagaattactgctctaaataaaagtgaataaagagaggattttaggttatggcagagtgaggagattggtaaatcctctctccaaaaaaagcagctataaggctggacacaaaatctccaacaaaataaaatcataaccattttagtactcttaacatctaaatagaatataacaatttgagaaggatttacgcttcaaaaactgctgaacttcatagttggaatctatggcaaccttgctcccaccctctccatttggttgtgtggaaaatctgcaagggttgggagtgttggggggtgggcaggttgtgcctctgtagtcaaacaagactcatagactttgagtggtgagtgattaatacgccctgaagagttgtcagtgaaagtgatgatcttggccagatgagggccaaaagcctgaagttatggttgtggttgggaccaatatatttctggctaccactgagcacatgcacagtggagaccaaagagaccctaagctttttatgtactcttgtccaaacctgaggctgtacacatttgcataggagccacaaaaggccaagaagaatataaaagccagagaagacttgtaaatggccttaaccgtggaatgcacttccctacccatataaagatctgtgaacagagaatggaagtctatctggctctagatatttgtgcaaaaggactatccagtcattggctgaaaacttacaatgaatcaggagtaacccttgggaagccagaattaaaaataaaaagcaagaataaaaaaaaatccaggcaaagatgtcagagactgctgatcatgaaggagacgtattttacagatttaagcctgggtaagttaccaaacaactccaaaaccttccagcaccgataactttcagataaaaaataatcatgttctggccaggcctggtgggtcacgcctgtaatcccagcattttgggaggctgaggtggacagacaacgaggtcaggaaagcaaaactgttttggctaacacagtgaaaccctgcctccactaaaaaatacaaaaaattagccggacgtggtggcacgtgcctgcagtcccagctactcgtgaggctgaggcaggagaatcacttgaacccaggaggcggaggttgcagtgagctgagatcacgccacggcactccagcctgggtgacagagcgagactctgtctcaaaaaagaaattaataataataatcgtgttccagagttgcgatactatatcattcaaaacacttttaaaaaatgggacattcaaataaacaggaatctgtgactagtattcagagagaaaaaaacagtcaaaaagtagaatggtgattactgtagaccagtgggggtgaagaaggaatagggagttattatttaatgggtacagggtttcagtttgggaagatggaaaaagttctggagatgcagggtagtgatggttacagttgagttttggccattatttcttcaaatatttattctctttcctctctttctggggctcctgttacatatatgttgtaaaaaaatatgcaaataaacaggtacttgtgactaaaactcagaaagtaaaaacagctgaaaagtagaatggtgatcaccagagaccagtggggcgaagaaggaataaggagttattgtgtaacgaatacaaggtttctgtttgggaagaagaagaatttctggagatgcagaattgtgtgaatgtctttaatgttactgacctgtactattaaaaatggcccaaatggccaagttaatgttatttatatatatatacatatttaccacaataaaaaatgtagacaatagaaactatgactgagtgtctccagatgttggatttagcaaaaatttcagagaattatattatattgccattttaaatatagttaagaaactaaaggatacatatatttaaagaattaaaggaaagtgccacaacaatgaatcaatagattctccactccccactatgttgatggccataaggatggtggcccatgtccgtgatacagtttgctgatgctgcagggaacaacatggaccttgtttttctatgattgagtgcgctggcctgtttgttgtctccctgagaaatcagctcaggggcttgcctttgttttacttaactcagaaatttctgagggctggagtggcctcctgaaagtatttaaaggcaaatatactagctacagcctcctgagataagggatgtgaaatcatgcaaacattagacatacagaaaagcctgggaaagaagaggcatggagggagagaagtgatttgaaaggctttcacatgtgccaggaaatctacaaagccacagataagcccagggctggattcatcttcagaaaagactcaagaaacaagagtttcacctctggttcaccgttaggatcagtgaaaacaggaagtgaaggctaaggaagagttataaatagcctgaataagtattgaagaaatgcctcaacatacagtcagtctgcaaagatgggagattttcttttctctttttttctcttttcctcttctcttctcttctcttttcctttctgctccttttcttttctttcggctctaggcatttaaggaaatacctgtcaaattgttatttgaccactaagctaacagagcagagacctcagtgaccacacttaacaaagaacacagtcttcatgcaaacggtttagaaaaatcactgaacaatcaaaacccatgacagcggccaacaataaacccaagggagggagagagagcagaatctgattttcagagatttgacattagaatattaaaagttcacttttcatcagaaaattacaaggcaagcacctccatgttccaggcaccgttctaggtagtagcaatatacctatgaacaacgtggacaaaaatccttgctcttgtgaagttggcattttattaaataaatatatttattcactaaggccttaatttttcagcatcttattatggtaattttcaaacacatagaaaattaaaacaattacacagtgaattgttcatatgtttaccacccagattctacctttgacattttactatatttgtcctatcttgtatctatccatgtagccacctatttatccatctaccaatccatcctttttgcttatagcattatatttaagaccacacaatgaaaacaacctaaatgttcaatagtaggggatttgttaaataaatttatgtatttgcactcaatggaatcatatgcaaccattaaaacttataattttcagactgaggaaaatctgtatctagttttaggagaaagcaggatattaaactactgtgcatttttattttaacactatgtaacaaactatacaaatcaaaagaaccataagctattgtagaaaaaggaaggatactttatctgttaggctagagggttttttgtaaccatttttttctttccccttttttgattttcattaatgttgttactgcattatttattccatacatacatttacaattttttaattgggacagtaaaatcattaactgtaatgtgcatccaaactatttagcaggacatggagaaaattgtaatatatttgattaactaattgcatattggatattttctagtgcctagatatacaaagatgaataaaatgagctattccttgcccaatagaagttcacaatatgttagagactatatatttccataaaagaataagtatatgatgaacaataattgtgctgtgtatgttatgtagtgattaagagtggattttgaactgattctttagatttgcttccaagacccatttcataccagctgtttgatatttggcaagttatttaacctcactttgcctgagtttcttatctctaatgaagttaaaattacttcctactcctcacatttatgtgaggagtaaatgagttaatacaagttaaaagctcagaataatctctggcacattataaatagtaaacaaatgttagctatttagttattattttaaatattagcatattgttaagatttcatgttaatatattggtattaagattctataatacgttagatttttcttcagaacttctactgattatgtatttatacatattttagtgcatatatgctgatacagtgaagtaaaggtaacatatttatgtttggatgatcagatattaaagttgcaaattttacttcagcccaatatatttatattcccttttaaaagtctttattggcaaaacatagttaaaatattccaacccttagaaacataaggtggaactcatttctaacttaaaaattatttaagactattttagggtacagactgattctcttagaaagtgttctgctttctattatcttagcgttggtgtttaagttgtataaatttatggcagcgtttggaactagctcaaggtttacatttgatcaggatatgtggtcagattaaaagcagtttttccttagctctaagcctaatgtcaatagaaaactatattgaaaagaaaaatgtctcttgagttttcagaatatgttgtgtaattccatggtaaatacaaatataaatattgtgattaataaaatgagaaaaacatgagaatttagatgcttgcttcctaagttaccaaagtgaaaagaggacatttatttttgtttgtctttacctcactttcacaaggaatttcagatggaacagttgccagtttataattctcctcttgaatattttagtgtcattaaatgggaataatttggatcacatacaagattatgatggaaatgatagaatgatgtaatgactttggagcgagttttgtcttgtctcaggagaactcataattggattgtgtttatggaagaagatgaagaagaagagacccaaaaatggaataacccttttatcttcatctgactctctattcttgtcacagtttttatcttcaggagggcacaaatagcctctatctgatttccctatcccatgcatagggttttcttaaagttttttcacaaagaagaatttatttttaaaaattctgttctattcttcatgtgttatttttaaatgagtttcacagagatactctgaagctgaagaggttgtttttaataatctgatgttacatgataagtactggaaaaaggtggatgcagggagtgggtggtatgataaaatgctgtgggtgtaggtcctgaactgcaggttggtaaatgtttttttggtaagtcaggagataatttaagcttacttatgtgattgctctattccccataatcctttgcaatgcttggtgagacagaatgaaagaactccaggtcttagctgtttgttagtgaactgctttttcttagagctgatgcttttggttatcaaggaagtctggatagtgatgaagacaagtgttgacaggagggaggctgaagattagggttatttttttgagtaagaaaacatgtaacttaattgtacacttaaaaataactgaaagagtgtatttggatagtttgtaatgtaaaagggtaaatgcttgaggggatggacaccccattctccatgatgctgttatttcacattgcatgtctatatcaaaacatctcatgtaccccataaatatatacacctactaagtacccacaagcattaaacatttaaaaattaaaaaatatatatgtgcatactctttaggaaaaaagaccactcccagttcagctaatatctgtgatctttttggatattttactcctgaaaatggcttcgatggcttcattagaaacaacctaaaatatttcttttccatagtgaataaattctgaaagatatttctcctcataaaatttaactaattaacctaatgccatccttggaatatttaaacgctatgtctgttgtgtttggtttaggaaaagacaaccctagaacccaatttttttcagattttgcactataaatttattcatatatattaaacaaagttgctgacagaaaaaaaaaaagttgtatatcctattacatgtgtgatttagtaatatcctttaggacacaataacaattatgaggtacaataaaatttcattctgtgcagagcttttcatggaacctctaacctcaattcttccatagcactgtactacaccacgcagtaaagaaacattttttcaacttatttagtatttgaggtataaaatctggagggggaaaaatgaggatttcagttggatttgaaatgagatggagagttaatgaaacagagagatacaggcgggattccttgggctgtcaagagtagggaagattgaagaggcaaaaatgaattcaaagtgcataggcagatgcaaagatatccatgaaggtctatcatccatgatattaactagagcaaataggcaaattttcttttccaaaaggaagctatatttaaagaaaaattaaacataaggggaaacttgagagtgatttgtaggaattcacatcaagcgggtggtcctgtttcttagcccatgctgaagcattccccatctgtcatctgaagggaaagagcattgaattcgtagtatgggagtttcccctgtggaggaatgagaagatgcagtgtgcagctaacaaccaaggcttgggggtggaagatgggaagaatctgaagagcatggaggtattagggccatgttagactgaatgaatgaaataaatacgggttagagaaaagtggagggaggaaaaagtaaaatcagtcaagaattctaattgcttactcatttggaaatgaatggacacttatgaatgagacctcgctgcccagaagataggaagtagcttagaagttgtttcctgatggataaagcagtgtgcagattccagtcacttgggtctgttcttgcttctcatgagcacacacctcacacgtacttgacctgagaggagatgctcttgttggaaactaagatttttttgtcctctcgtgcctcacattatgcagtcgctggaggtgaaagatcaaagctggaaaagtcatctttgaaggggaaacacctttcctcactcatgtttacgatttttttctgtcttggtttcatagaaaaactatgcaggtagccagagccctaagttgttgtgccatctgtaaacctgacatcatgtgcaaataacaacagatgatggaatttcacctagggtctgatcgtgcccagggagacttcataggctccaaatgcctgcttttatcttatacatcgagaagccattcaaactttcagggctctgccaacttggcaagaagaagagttggcaagcttcccatgctagttttcttttagtttgaaagttttgaagtgggtctgaggttgtgataaatgcttgtgaggtctcttatttgttgactgtaagcttttcatcatttgacatgaatgagaaacatcattcctttgcaaggatattcccttttttctgtttctttaaagttatcttagagacttctcagttactgtatgaaaccataaattctctgagcaaatgcctgttttgacagagagctttaaagatacatggcaaaagtttaaacaggtcctaactgatgggatttaaatactgtatatagtaattaaatagttgtgctaataaaaccctaaagcactgcttgcatttttcttctttaatctctcaaatttttctccaagactcaaaattcatgaattaaatgagttagccaagggaaatataattgtgttaaatttcctaagtgctttacacactgatgaaaaaatttaaagtttataataaatctacaaattataggtgggggctcattttaccacatagcttctttaaaatgaaactcccaagcatggtaaagaaattgcatataaatacttgctgcagaagtaagaatacataaaaaaactcactatgtacttgagtctatttgatttgttatgtttagatggctcccatatgaataaaataacattacaacaaagcattttatgactttttcatatggattgattatatattgtgcatctcaaataatctctatctcctttaatattcctctataagtcaccattacatagttttagttcttacataatgggatgctattaaatttcttctcccccttttcttaaaaacaaaaacaaaaacagaaacaagaataaaaaaacactccccaaaatgctatgctatctttttaaattttacaacatttttagccatgggcttcatatctagctcaaggtttattgtctttctactttttctaaatgatttaaggcttctctttctcactggacttaccataaagtgacttcttgctcttctgtcactttctgaaccaaaatttctagcctcattacactgtgagagacttaggaccaggggcagaagagaagccttgactctctttgaggactagcataacatgatatgaacatagcaggccactgatatgtgagcatcccataaataaaagagaattatcgccaagaagcccttactcagccagactacatttccagtttctcttgcatctaagtggaggcttgcatctagttttcaccattggaatgtcagataaaatgatgtatgttctttctagcctgttaggaagcagatgtgacttctccatgctgcctttccctgtcagctgactggctatagaagactctctggacatcacaatgtcatcctagccacaagatcaaaaagagtagagtttctgtgtcaccatgtggagaaaagttatccaccaatctgaaacaattacgttagactactgcatgggcacaaaataaacctctgttctgttaaaccactgaattttttttatcgcaggtaatgttatcttcactaatacagggaagaagtcctgctgcttgtcagacttagtagggcccactaatcctgttgaacccagaagaacaggagcaaagctgctctagtgtgttgaatggcgccaataccttgtgaatgagagaagtctgcttgaccaaaagacctaggatacaatggatgccttctacaacttcctcttagtgactataaaacagagaaaagcctcttctaggacttccatggtagattttccactgcttaagcaatagcatctgcttagtgaatatgtctgctaaagaaaaatccagacaagttaatattcacattttatttaagaatattctagatgaggaagcaataattgaacaactagaagtgtaggctgtcattaaattagagctaatagaggaactggaagagaactttatcaaaaagagaagtgctctcaagaagactgaagaaaatcgtgaaaaaagagcattcaaaagtattctggaacttaaactgaaaattctacaaagctcaatagatgagctgaaaaagaaagtcactgtgttatttatcatgtaagattaatgttaggaataacacataaaagaaatatttcacaatacagtgcaaaaatcgaaaaaaatccacttaattgtaaaactagctctgaaaaactgtggggaatatatatggagagatccaatatttccacttcttgctctgtatacaaaggaattgaaattagtgtgccaaagagatatctgcactcccatgtttattgtaccattattcacatagccaagatatggaagcaacccagtatctatccgtagttgaatgaataaagaatatgtgagatacacacacacgcacacacacacacacacacacacacacacacacgatggaatattatacacccttaaaaaagaagaaaattctggcatttgtgacaacatggatggacctggaacattatgacattatgctaaatgaaataagccaggcacagaaagacaaatactgcatgatctcacttatatgtggcatctgtaaaagtcagtctcacagaaacagagagtgaaaaactggttagcagaggctggatggggatttggagagaagaggagctgttgattgaaggatactaaattccatttagactggaggaataagttttagtgatctatttcactgcatggcaaatgaattataaggtattatgtatttcaaaattgctaaaagaattgatttttaatgttcccatcacagaaaagaagttggtaaggtgatagatatgttaattagcttgatctttctacagtgtatacatagatcaaaacattacattgtacattatatattatataatatattttatataaaatataatttattttatatattatatactttatataaaatataatatactttatagtatctattttatatctataaaatcattatctctcaaataaataaataaataaataagaaagaaatttacctagagagcaaaatgccacatttataaacctttaaagcacttgggtatcatattttgcttaacaagtattgctcacctcagagtcttaaaatgttctatttaataatactattattttatctttcaacatttaatttttaaaaatgtaatttttcactctgatgataatttcttttgctgtgcagaagctctttagtttaattagatcccatttgtcaattttggcttttgttgccattgcttttggtgtttagtcatgaagtctttgcccatgcctgtgtcctgaatggtattgcctaggttttcttctagggtttttatggttttaggtcttacgtttaagtctttaatccatcttgagttaatttttgtataaggtgtaaggaagaggtccaatttcagttttctgcatatggctagccagttttcccagcacagtttattaaatagggaatcttttccccaattcttgtttttgtcaggtttgtcaaagatcagatggttgtagatgtgtggtgttatttctgagggctctgttctgttccattggtctatatatctgttttggtaccagtaccatgctgttttggttactgtggccttgtagtatagtttgaagtcagataacatgatggctccagctttgacaacctacagaatgggagaaaatttttgaaatctatccatctgacaaagggctaatatccagaatctacaaggaacttaaataaatttacaagaaaaaaagaaccccatcaaaaagtggacaaaagatatgaatggacacttctcaaaagaagacgtttatgcagccaacaaacatatgagaaaaagctcatcatcactggtcattagagaaatgcaaatcaaaatcacagtgggataccatctcatgccagttagaatggtgatcattaaaaagtcaggaaagaacagatgctggagaggatgtggagaaataggaaggcttttacactgttagtgggagtgtaaattatttcaaccattgtagaagacagtatggcaatcccttaaggatctagaaccagaaataccatttgacccagcaatcccattactgggtatatacccaaaggattataaatcattctgctataaagacacatgcacacgtatgtttattgcagcactattcccaataacaaagacttggaaccaacccaaatgcccatcaatgatagactggataaagaaaatgtggcacatatacaccatggaatactgtgcagccataaaaaggatgagttcatgtcctttgcaggtacatggatgaagctggaaaccatcattctcagcaaagtaacacaggaacagaaaaccaaacaccatgtgttttcactcataagtgggagttgagcaatgagaacacgtggacacaaggaggggaacatcacacaccggggcctgtcagtgggtgggggactaggggagggatagcattaggagaaatacctaatgtagatgatggattgatgggtgcagcaaaccaccatggcatgtgtatacctgtgtaacaaacctgcatgttctgcacatgtatcccagaacttaaagtatagcagaaaagtttaatttgatgtattgtatataggatgaggtagaagttcatttttttccacatgtatgccatttatcagtgccatatactaaaaaaagtatccttttcccgttgattttaaatgcagctttcatgatgtattctatccttttctggtatatattttctgggctctttttttttaaccaatattttgtctattccagtagccatatcatgctatttggttatgatgtcttcgagactgttataatgtttggtgaaaaaagtactgtcagtactgttttcttttttgtaaacatttttgactttctattcattaattgaattttaaaatcatttgtcagtttacaatggttactggaaaacattgacgttgtaattctatttttcattgcttactttacatattttatatgatttaacacttttaaaaataaagatattatacctccattatgaaattaatttttacatgttttataatttatattgcttttgtaagtaggactttttaaaatatccactattatttgattattattgctattattgaaatgctgctgacttttttatatgtatatttgaatccagctactgtatttaattatctaactaactcaacttctttcttaaattggaaacaaagactgtcttttcttcacaatatttttacaaattatgtcatttttagagtcatttcattagatagaacttcaaaggcaatattgaaataagtatgataaagcagccttctttatttttttctttatgtgaatggaaatcatttcagtgttgtcctgtatttggtgtttgctgttggactttcataaatagtctttaagatgaatcttcctatccatatgttaagtagagttttattacagatggctactgaatattactaaatgccttttaggtgtttattaatacaattacatcatttttctcttcttatttgttagagaaggttatggtatcctagaatcagagagagaaaaagtcaagaaggaaagagtggcacctttatataaaaatataaagcctggcttatgccctggtgaaacattcagcaagggagataagactaaagtgtttatatcagcactcataggatataattcacatgaaattatgcagttaagagaggaagcacagatatgagtgaggtctggatttcacaggaaaggctttttgaaaaatcacaatccttaaagctggaacaagataggacaagcttattcatgacattatgaaagcagagaaaagattaaagaactgaaaattgcatatatgtggtggcgaaaaagttattcagcccctagaaatgaaaatactggtgactttaaatatatgaaaacaatacaaaagataatttgttcttcttcactagagatagacaagagaatgactaaagtactaagttaaacaaagaaaattatagcaatgtgaagtgttagtcactggaatcttttacctcccaacacagttttctgcaattttaaaaactttctcttctgcttgaaagcagggacaaggagacctttcttagaatcaagattcattgattttatgaagtatattcagaaaaaccagttctgctgcttagtgatctgtttactcctgaaatcctgaagtgtcccaaactgtagggaataagatcagaatgtgtagggtttttagaacctagaacaccatgaaattgcacaaactagggggaaaaggactgaacaggcacttttcaaagaagacatacatgcagccaaaaagcatatgaaaaaatgttcaacatcactaattattagagaaatgcaaatgaaagccacaatgagataccatctcacaagtcagaatggctattgttaaaaagacaaaaaataacaggtgctggtgaggttgctgagaaaagaggatacttacatactgcttgtgtttttgtaaattagttcagccactgtggaaagcagtttggcgattcctcaaagagctaaaaacagaattaccattcaacccagcaaccccattattgggtatatacccaaaggaatataaattgtcctaacataaagacacatgcatatgtatgttaatcgcagcactattcataatagcaaagacatagaatcagcctaaatgtccattaatgatagactggataaagaaaacatggtacatatacaccatggcatactatgcagccataaaaggaacgagatcgtatcctttgcagaaatacggatggagttggaggccattatctgttcctgcatttgcaggaacagaaaaccgaataccacatgttttcacctataagtgggagctaaacaatgagaaaacatggacacaaagaggcaaacaacagacacgggggccttctggaaagtggagggagggagaaggagtgaatcagaaaaaatatctgtcaggtactatgcttggtacctgggtggctaaataacctgtacagcaaaccctgtgacatgagtttacatgtatagcaaacctgcacgtgtacccctacacctaaagtaaaagttttttttaagtgcacaaactagaggcttcttttaaaagatggtggagtgtaaagccaatttatttgcactagcttcttttgaaacccaacaaaaacaacaaaaaagaaagaaaactcaagaaaaccatcagtttatttaccatgattcattatgcctgaattctttactctgatttatttctttgatgcttatccttgagtaggtttgtttgcttgttggtttgaaagacaagctcaagatatttcactgtttgaggttttttttgttattattttttttttttctgtttctacagcttcttttctggcctagttgaactacttttattgatcagaattggcatgttacaatctacatactaatccacatataatctttcgctccttgctcctagtttttcatcttccctggtgaactaccgattctttataattcagctcaaatattaataccacctactttgtgtaaactttcctgacttccccaggtagagctgactcttccctcttttgctacctttgtacctttaccatttctttatcttccacctgtaatgataggcttttactttgtttttttcttgtttgttatagaccaagttgggatcagtccctgctctacttacctcctccctgagaagcttctttcttcaatcaggggcaatcttaaacaggacattagcactagatacacacagacacagatacacacacagacatgcacgcgtgcgtgcgcgcacacacacacacacacgcacacacacaccccccaaataggttttcttgaagttttacagaaaattcctggggagacatggaagaggattaacatgatgcactccaaagcacagacttaataaaagtgcattggctacctctatttttccccaagcaaaatacctcatgtttttctttctcataatgtcatctcttccatatgctttctaaaatgtgcccttcctcattctaagcaggttagttgtcaccctcagcttgcataagccacccagcagagcaaaagcctctgttgtttctaaaacctgccctcttgggggcctcttccttccccttaggttgcttatcacagtctccagtatttgaaaattcatctctcttcttttggggagccagtaaatagcaacaggagattaagctgctaataataactaacatttatagttagcttattgtatgccaggcagcatactaagtactttctatattacattaaataagattatctttatatccctctacctgcaggtttgtctcctacggaagactgtaagcatttgcacagtgatgactatattatttttttctgtattcttaatacttagcaacatgcctggcacatagtaagcacttcataaatgcttgttggatgaatagtgtgtatgcattgatgtgatgtaattggtggtgagaagaatcagcctgttcacagtaactttagtcatagttctttttatatttgttttttgttttcacttcaccatggttgtcttccactattcatcatgtagtcagtacaagccctggttgtcactctgttagccatggatattttcagctcttatattctgacaactaattattccatgggaagtcttttaatcaggattctctttgtttatattgaaatgactaatatctttctcacacatctcatttcagcaatatgagttgatgctgtattttggatcatgtattttagaccaggtggccaggcagcagcactccccaccaatgcagacaggttaggttttcagtctgtgcttggtgcatctctagggggttaatgaagccttcccgtcgaagccgctgtgatgagaggacaggcaggactcctgctccctccccacctgctctgagttctaatccgagcagctcttcttctgtctggtttacatattcatcttttgggtgaaatggtgttaaatataatatatttgaaaacgattgggttaaaaaagctattctatttaaaatatcaagatggccatacataacacagatagataggtcctcaacattagcaggttgggtagtgtagtcaactgctgaaaataaatacagcacaacccaacaaaacacctttcccctcaaacactaacaaagtaaaataaaataaaagcaaaaccctgaaacccaagcagaaatgtaaagctgaagagacattttctagattggtcagtcacagcagtgtattcagaaggcagttcttcctccgggtttgagaggcctgtagccatgtatacagaaactatcttgggtaaggtgcctctactctgtcgggcttactatttaagatccttagtgggtgtcagaggcctttggcctgtactgcacaggtcttttcttgtttgtggaacgtcaaattcattttctctccaacaggccttttggtttcttaaaactctccggttcttgtccctgcacgtttttccctctcaatggcatttgactcaggttgccagtcattaatttccttgtatggaattaaggagatcttctggtccattctgtggctagaggcaataagagaacccatcctcatagatctagtctcaacatgaagcattagaatgtaaactcccaactctagaatataaataaggtcactgaggacagggatttctaactgttttattcatagatgtttccctacctcctagagcagtgtttagtaatctgtaggcactcagtaaatattgtttaaatgaatgaaggaaggaaataccggtctcacagtcacgccttttatacttttgagaatgaatttctcaactgtcttatccctcgatctgttattaactatgctaaaaatatttcctggctttgagtagcattgtagaaggtcctcttccattttccgattttcatagatgatcttccattaaaaaaagacgctggcatgtttctgctgtagaaaaaaggaagcaaagggatagttacaactccttctactcttctcccccagaaaaacctttcgaggcctcaccaatagatggcttgctttctcctccaatcaccagcagacagaggggccctggtgtactgctgtgttctccacaccaagggggaaatgaataatgtgtgagattcctctctggaatgttgagtgtctcaaccttccttctacaattatattttctgcttcacggtgatgacagcatcacctgtgggttcagaatcagagacctccagcttctgtccccattttggggtaatgtatgtgccacctttcttggattttatttaatcagtgagtctcctccccaggagattggggactcaactatctctaaacattttctcatcttttcttcacctagggttcctgggctcctgttgggcctcactggaagctcctagggttaaaccaaccttgggcattaatttcagtgtctgttctccacagtcacaaaaatatggacctctagttacacttcataaaatagcagagatcctacctagtccactgacagatgtcagcatagcatcctcttctagaaatttactagcttatgttttctgggtacccccaaattctatagcaagatctaattctcagtgcagatcttaacaccgtatctgagtattttgtgtctatatgagtttgcctattcataagagtccagcgaatggtattaaacatccccttttgtctcctgcaattgcccttagatccttcctgaggatatgccagtctagttatgagaggtgatccggacgttgttcatctagagttaatctggacattgttctagataaaacacacataaaaccatgaactctaaaatgtcctcagtcctttaaggatgatagaatgtgcttataggttatagctaggttgattatataatttattatttaaaacatgacaccttgaaagcaaaagggaacggtatttataattacattgcctcagaagtcataaaccaggacctgtagtcactctggttatggcagaaatcttgcattggaaaatctttccttcaacttatttcaccctacatggtgaaaattttttaaaactcttctttaaagtagtctttcaccttaaggattcactttttccgaaccaccaatgtcctttccgatataattatgtggtctaattcacccattccttcacattgttcatgttcttaaccactttctctatctttactagagttggctagggctctagagatgtcctaagctttttcttgaatagcagctgactggacaagtgaagactttcttttctaacttatcctaataaattggaatctcacttttgttttgtttcaacgccaaatgaggactagcagtggcaagataagggtggaacagaggaggaaaaggaaggacaggataaaggaaggaagcctaccacttacgtatacatcacacctgggatgctcatgctcttgtcccctgcctgcgttagccttggactcactgctcccttgagatgccactaagagggaaagggagagcatatttagaacactcaccccaccccaactttaccaccttcactgatgctcctcaagtccttaaccttctcgctagcttccccagcctccttcctggtcttgagcagcattcatgcggagtctcaaatcagagccccttgccctgcttcctcacttgcctcatactgtctctgtattgctttcctcttgcaagaactcgttcaccacactaggagaaaagcctagaagaaccctattcttattgctttatggatgagaatgtaaggggttaggaagagcccccattttcttatctttatgttgaaaacgcagggtgatatgtggtcttgacacatcaatttagaattccgaatttattttctcatcaaaacccctttataactggccatttggtttcaaaatactacaagtagtacccactggatatattagctatattggtgtttaaatagatgtttatattcttatctatcagtctaattaccatgtataatagtatttccatacaaaaatctgagcttagttcctcaagattgctcagataaaatttggggagattgtctatttataattaggtctatctcccttttttgctagttctcatttgaatacattcaattccaagctgttaaaagttagcaatgctaatgatagtgatgatcactaatgtttattaagcagccttcatgtagcaggtgctgcgttagttactatattgtcattataattcatatctcactgtgatgaaagtattatttccatattacagatgaggaaagtgaggcacagtgaagaagagtgaggggcttaagcttatgtaatgaataaatgataaagctaagattcatgcccaggcttgtcagactctgaaattggcatatttttacaatgccatgtggccacctgtgcctggccatattttaccatgtgttaccacgctggtgtgtctattttaggttaggagcaattttagagagaagcagtgccctaatctgcatcttcaatgccatttaggtatgttagttaggacagttggatgctaaagcacttaaagtaacttttaggtcatttgcattttccaacagtggtaaatgaagatatcaaataaatcatatattccctttgatttggagttgcttgctatgttctctcccttctgctggtttttcattcattgcagccaatagctattggattcatgttgttggctaaatctaccctttttctaatcatgcttcctgaaggttggagggggaaatatttgccataaaattgatttctaagggcagggcaatgagtaaggccgatatcggaatgttgatagaaaaaagcccttcttttgtcttgttggctgtaaaatatcttgcatggcccagagtacaatgaacttaaaatacaaggagagcgcagtgcaagtcaccatgatgactctgacatcagtattttccatatctcttttaacccaattgtgactttgtagaatgtaaattgcatagaaaatatattttttcatactgtctctaaatcctagtttcctttcttgtcatattcttttttttatttttcaattaaaataggatcctgttttcctttcttttcatagtctttttttatttctcaattaaaacaggatgggtaaaaaggacacaaattctgccattgcaaatgatctatcagttttgggggacatactgactcaatgaagatccagtgttgtctttcaaaatttcatttacattccgctcattcacacttttaattgttattcccttaaaaattaataaataaaaggagccatcttgtttacatatttctgcactttttttcttcatagacagaagtctttcaaatctgattcatatttcttttcagattgcactcttaagttcaactcttcacggacgtctataatattccttatctcagctagttctccagaatatgcttatgaaacagaaaaggttcccttgtccccctcacagggcatgtggtgggggtgtggctcacttcttcagtgtcctgctgctgaaacctctaggggagcatacaaactgacaggctgtggggctccaaacccacgacagtgtctaggggtgaacgctgagggccccagtgggctgaagccccagtgggcgtgtgttacagggtgcttttttagtttagccatttgtaggtggcttgtattagctcagttagactgtggtcttaattgcagagacaaagggctttctgtatcctgggactcttgccttggtgttgtacggatcatatgtggacttggagaatgagtgcaaggttttattgagtggaagtagctttcagcagatgggggagccagaagggagatggttttcccctagagttgggcctccgcttggcggactgggctctcctccaactgccccagccaaactccatgtcgttctgctggttggtggcctgctggcctgccgacgtctgtcagtttgttcttctcgacgtccagccacctgtgtgttctccgctgatgtgctcctctccatatccagttgcttctgtgtttgcctgctagggtctcgcaggttttcgtaggcacacgatgggggtgtggcagaccagggtggtcttgggaaatgcaacatttgggcagaaaatgcctgtcttcacctaggtccatacgggtggaaccctagccagggaccatgctctcctcctagcacttcccttcctgccttctgtatcatttaaagggaccactctcttcccttcccagcactcccatatcacttacaaccaacctctgattatataggcaaaaaaaaccatggttctagtgaacaacctgaaaaccacaaataaaagatgcatcaacgaattatactgacattataggaagatatgcaaatgtactatttctatggaatgaatactctggggacaatgtctcacgctgtgcattatggaatcatgaatttcagcagtttcatttttctgtgttttacattaaaatagcaaagaaagagtacatgtctagaaaactatttcttagtgacctgttagacacatgccagaatgtctaatgtttttcacatgtggttcacctgagcctgtaagatttgataatgcaccattctgaaataaatgagtgcctctaaatgtagtaacacttctcatgtccacttaaaggtcaattatttcaaccattatggtttaggaaaatgggctggttaaataagctgagtaaaataagcagcccagctcaccaagaaaggacctgatttgagagaaatgggactaggcttgcttttctcaagtccatcctcaatagccatcagtatcatataaactaaaatcttatataatcttattttaatctcaatataagataaaatctgacctttaataagccccactgtctacactttttttttttttttgagatggagtttcaccctcattgcccaggctggagagcaatggcatgatcttggctcactgcaacctctgcctcctgggttcaagtgattctcctgcctcagcctcccaagtagctgggattacaggcatgcgccaccacacctggctgattttgtgttgttgcttttttttttttagtagagacagggtttctgtttttttttttttcagtagagatggtttctccatgttggtcaggctggtctccaactccagacctctggtgatccacccgcctcggcctcccaaagtgctgggattacaggtgtgagccaccgtgcctggactgaagtctacactccttaacatggtgtacaaagttcctgatctcgccactgccagcttttatagcttttttgcttatcctctctgtctactacttttagccacctgaactgctaatatttccttccaatgtcctttgctttcttagccctatgtctttgttaggctgacttttctttttctccttgagatgtctttttttctttttgcgggggttgggggggcccaacatttctcgatctcatttgtggattattttcaggatcactgtgttgtccagaaaacggacatggaccattgattaggttgggttgggctgtcttctctaatccaacagtaatagaataaccaacacttacagagtaatgtgagaggctcttggtacatcctgtaggtgcaagttatctaatttgacccctctacccaccctatggaggaaggtatatgaggctgggtcttatgtaataataactagagcacggattaggtactggcttttcagtatcttttcctcccatgcctttatccctatatctgcatgtataactaggtccagaggtgggtaaaccttgatgagttcattcacttctcatattcagtgattgctcaggaaagggcacgagattgggttgtgatctagagggcactaggggagctattaggtaggttgcctttacctagaaagatgagatcgtctgtatgagagcattttgcacactgaaaaagccatcatgctagttttaggcttcaagtaacaagaaacccaaaagattaaacaacaagatttattatctcacatcacaagaagttcagagataaggcagttccaggattagttaattcattagttaataacaataaatatataattaagaacccaggtctcttttcatctttctgccctgccacacttagtgtattggcttttgtcttcagggttttcacctcgtgtttttgatatggctaccacgactcctagactacctcattacacagcatttacaggccaggataggctcctcttcatgtcattatatgacaataattttcatgtcctttttaaagcataaaataaaaattcccacacacctccaataaaactttctgttctgtcccataagctagaactgcatctcttgcccattcctgagcagtcagtgaaaatggaagtgaaatgacatgattgccaagactgatcaaggtttattccctagaaggattgagtttcccagaggcacatagtcattcaatgtttgaatgaaattgggattttggtaaaagaagaaggggctaggtcatgtctttttattaactagtggtacctgccacagcactatacaaatatgagctctcatttttaatattagtatatcaatgtttaatatatggcagtggtttcagaaagattcatttttgagataatttttaagcaaagagggtaatagtgttttctttcccatgttttaggttgggttgcctcagaagcagaacctaaaacaatgatttgagtgcgactagtttatttggaaggtagaggcggaggggaagtgatacaaggatatagggaagagaatggattatcactgggtgaccgaagctcattgccataggggcactctgagaaatggtacagaattacatgcagagttatccctcagaaggaggaagggagctggggtaattgtaccccagcttttgccagttatctgttgagaaactcagggaagtgtgttaatgtccccagggcccttgtgatatggtgttttgcagcttgtggggaagctttcaggcaaagacatacagatattggaagctaaaagtcccagggaactgataaggctcaggggatgtgagaccaacaacaactgccacattcctttatgtccataacacaaaataaagagcagaaatgtcacagagcctgcaaagggatggagatttgtttcgtcaagaagggaaagaagcactttcatattttttatttagctctcaaatggggtactttctaaagctgtgtgatttatgtatgtattatagccagttgtttccctgcacactgcttacattcatgttatattctggcagaaaaaatctgattttaattgctctaaaaatacatgttcttatctgcaggatttgtattgaggcttactgagagcagcttaaaggtcaaaaccttatatttaaactattagctctaattgttagcggagtacattttaatgttacagagttggttaaactgctggtatccttccaccttccaagatgattaagagcgcggaaaaataatttatcttaaatttttaagtgtgtgtttaattttctcatttatggcatacgtaacagaatggcaattaattattaagtctaaagaaagagaatcattgttcaaaatcagtacactatgcttcatttaactcctataaatatcacattctagagacataaacttgcgcagtcagtagcaaaaggtggttgttaataatctgttagtcactgtgtacactcaattggccaagcattttctccacttattcttttgttattttctcttttattgtcccaagaatacaaagcaattagccaaaattatatgacaatctctggaaattattttattttccatttgtggtttggggacagggaaggtaggaggaggagggatggaaagaacttgtcaaaaattgaggcaggtgtagtagattgaaatagtaggatctcaaaacatgtccatatcctaacctctggaacctgtgaatgtgaccttatttggagaaatggtctctgcggatacaattaaggatctcaagaggaaataatcctggattcagggtgggcttaaagtcagatgtacatttgaaacacagggatacacagggaaggtcagagggatactggagacacagtatcccagaggacaagagcttgtgaagatggtcacagagattggagtcatgtggtcccaagcaaagggatgcctggagtgaccagaagctggaattagcaaggaagattcttccctgtaccttctgaggtagtacagccctactgacacattgattttggacctctggcctccagagatgtgacagaataaatttatgttgtttcaagtcaccagttgtgtggtaatttgttacagaaacccaagaaaacttatatagcaggtattttattagtggtagtaatgataatggaggtaacgttttgcctataattttatagtttaccagatgttctcatctatgattatcagagtcaaatggtaagctgaatgatacatagaaattaaatgtcctgccccagctatagccataagcagtccagtatctcagacacagagccactagcccacaagaagctacctccgggaagggaaggttgaggagcttcctcaagcctctaaggagtaacaaatcctggtggaaagttttttctccccaccccatattttctaaagccagccttataaaagctgtgcttccattttctcattaaacgttcctctcagccagcactcgacgttcactgtgtggacacattccaatgagttttgtttttttctttaccatatggtgatttcaatttgtactcactgtagattcattcatttctttattaaatgcacatttacttcatacttcccaaaggcctaacctgtgcttatgctgaaggacaatagcagtataatgattttagtacccatgtttcttagaaacgtagccttcacattttgtgcacaaaacaatcctgtataactaatcttttttttttttttttttgagatggagtcttgctctgtcacccaggctggagtgcaatggcgcaatctcggctcactgcaacctccgcctcccgggttcagccattctcctgcctcagcctcccaagtagctgggactacaggcgcccgccaccatgcccggctaattttttttttttttttatttagtagagacggggtttcaccgtgttagccaggatggtctcgaactcctgacctcgtgatccgcacgtctcagcctcccaaagtgctgggattacaggcttgagccacaactaatcatttttaacaaaaaaatttaaggacaagatttgtgcagtattaagagccattacttattactgtgtgactgagatcatttatagtcattcaatgtttgagcaggttagttttcattagcagtttctcccccctcttggttaagagagtgaatgtttcagatgtggtgacttggttgcctgttgttcaaatatacgctactggcagtttctcaaaatgtcaatcacttcatctctgctttaatttactacatatattgctcagagtgctgaattaatgatgtgaacttgaagtttcaggtcttcaagtaatccctgggtgatgcatcgggattaggcctttgtagtagaaattatggacatgcgtgctgagctttttgtgtcttgctattttttcagccttgtatgaagggccaaaagatgtgaagccttattaaacccagtttatgggaatctgttgttttggactgagctcctgcaactaggcccataccagaccaaaccagaatggagtcactcttgctgggtgccatgtaataaccaaactgaatgaccagttttccaaaaaacaggagatttcacagcaaccaatcagaaagggctcagtctacctaaagcctggaggataaggaaattctgtctactttaaccttataaggaaagtaactttgaaatgaccaatctgcttttcgttctttatttcttgatccttatttctgctttctttagcaatttctgtctataaagtcaacacctgctgctcggctcatgggagtttctcctgttttgtagacaggatgctgctcaattctgaatcgctaacaaaagccagttctatctttaaacctcagttagtgaaaattttgttttttgacaagctataagaagcacatagccacatgacttatgattatacatttttagattatttcttaactattaagattctcaaaaatgtttaggaaaataaatgacctctaggtttaggtttatggtggactaagtggtgaaccatttgatcttgaaaaaagaaaaagaggatgaaaagtaacaaagttgcactcatccctgatttctaaacatctggtcatattaaaagattctcatgtattccagaacttaaagtataattaaaaaacaagtttctcttttttaacttttaatcctaaatagtatgtagttttaaattctcatatactattgtatacctcttttactacaatcatcactttctttgcaaatattttcattggaatcactagtaaagccatatattgccttattcacagtccaggtaaagaatttgagagccttcttacctgtgtttggacattcattttttggatatactttaatgtgtccacatggatatacttttggatacgctttaatgtgtccacatggtaacttgaagcaatagcaactatgtttaacttatcaaattttccataaaccaatttgatggtcaatccctgtaatatttagttcttcttctgcacaagatatgttcttgttacaagtctttctacttattaaaaaaaataccagttaaaagagaaggacatttaggctctatcttttaaaacctaaattattaattacacgtatgtttcttgaggatggtgtggagatccagctgtgaaagcctaaaacacaggaagggccacaccgtcagattcgagcgttgctttatctggaagggtaatttcattttcctcagtgtgagtggtgaacaaagaggaactaaaggtagagaccagatggagaactgggtcacttttctgggtcttgttgtatttggatttttattctttgactcaagttttgtttcagatgtggtgaactttaagaaaggaggatatgctgacgttcaaatataaatatgtattatgttcttacttttatccatgcttctgttttcctccactggtataaaaattgccttaaatatagaaaagaaatttttttctacttaataatgtatgttatgtataattgggatcaatgaataatctcgttgatcaagagtgtcttcaaatacagatgtattttagaagggaatggagattgctttatgtttagcatttcaatgtgtagcatttcaattgagcatctactttggatcagatcctcagagtctaaaaatagttttaaaataatttcttcattttcaaggggcttaacattaattgatggggagtaggggaaggatagtttttgaacagaaaaataaaagacagttactaaagagaactatgaaatatattgttgtccttggagacagagtctaaaaatagttttaaaataatttcttcattttcaaggggcttaacattaattgatggggagtaggggaaggatagtttttgaacagaaaaataaaagacagttactaaagagaactatgaaatatattgttgtccttggagacagaattagggacaatagatgaaagaggcaaggagagaggttctgacttattaccagaataagcttgataatgatccaagcataaaaaacgatagaatgactctgtctattgggagctgatgagtactttctagttagaaatatttatgcagaaaatgaatgattttatctgagtactactacttggtttagaggattgaaggaactgccaagattcctttagaatttgagattgtatttttgaattagttaggcatctttataggagttatcttggctgggcgcagtggctcacgcctgtaatcccagcactttgggaggctgaggcgggcggatcacctgagatcaggagttcaagaccagcctggccaacatggtgaaaccccatctctactaaaaatacaaaaaattagctgggcgtagtggcgggcacttgtaatcccagctactccgaaggctgaggcaggagaactgcttgaatccaggaggcagaggttgcagtgagccgagatggcgccattgtactccagcctgtgcaacaagagtgaaactccgtctcaaaaaaaaaaaaaaaaaaaaaaaagagttatccttttctccttgaagtcttgccaaggacttgggtgggcactgtgttggttaggtagctaggaagctgtggttgattaactgttaaagtcttgagtatatagtgaagaagaagaaacagggcagaattaattatgcattaaggcctcccagtatcttccgttagctgctgtgattttaccaggaccctcactttccttcactttccttggattagatggtcaggtggcactgaagtgacttgtaccaacaggcttaagcatgagaactaacctgatcatattatatcctaagaaggtattctagaattgaatttgtagaagatttcactagttcttcaagtatatatttttagattcaagtattaaagttagcactaatgtaattcactttgtttatggagaattgtttacttattagaatctataaaatagttttgatctaatggaaacaggcctgttggttataggagggaaatgtatcatggtttgacaaaaaaataaaaaataaaggagctggggcatgacagctcttagaagtaaaatcatttgaactatttgtcattgggagaaattacctacagtatcaaagagttgtcacaaagaactttcccctgatacccaacaacatatatgtgtatatatatatgcacaacgttgacttccagtgatctccatttaatataaaataattatctgtgacaattattctttaaaaatgcattctccattaacataagtggaatttcgactagccaacactttgaacttttatgtctcaagtggaggagtttactgggtacagaaaaatgaaggaaaatccatagcctgaatagaagagaaatgagcttagttttatattatactttaggaagaataaagaataatatatgagagttggaggtgtagagaacatatgtgaaatagttggcaattatttattttattccctttgaggacagttcatctttatacataagtattaacatggttaaatgcaaggaatctttaggagcaaaatgataataagaggttatttttatctttgaacaaaatctaacctaactgggctgaaacccaataggtaacattggtgtgtgtgtgtgtgtgtgtgtgtgtgtgtgtgtgtgcatgcatgtgtgcctgcatttatgtgtgcatgtatacattaagtcacattttttatatttgtttcacttttgattgaaggcagatattgttggagaacagatctatttgtgaaaccttattgggaacatccaaattggcaaaatgacttggtgcccatctgcagtaaattaagatgtacatctgactaggttggggcttcatgccagtgcctgtctcaacatgttcagtttttaactgaattctgtcaaaattccgagtcagataataattaatgccacagacatttaatgcatctttattatgcaagtgcctgtctttgtgactgtagatttagtcagaaagggtcagggtggcttcctggccatgatattagcctagagctctccctactccctccaacccccttccttctgttttctgttcactctcattctaccctgggattgatcactgggatagtggttggaaaatgttacttcattggtgaagaaagctcatatgagatctatgttgtttgaaagcattatatggtgtcctagttaggattcttccaaaagcaaaacctgacacagtgactcagatatgatagtttatttgataggtagttccaggaaacaagaatgagggagagtgaggcagctttaaaaaaaggattttaatgagcagattaaggataagggtaactaggactaagtcctgctatagatcttgtataaaatagcctcagaattgtctacacctagggacagggaagttgagtatttgttcacttaccccattcttcattgttggtgttttctcttgggggtgtttaatctctggcactttcagcctgccctaaacatggactgagcaggtggagaggcagaaagacacaagtgctttaagttggggagctgttggtgtgtataggaaccagatagcttcaggtgaactcagaggtgggctaagaggacgtgaagcagggcatcaccaatgtaagttccatgcggtttctattgaaaaggagcttcagggctctattaatgtatagaatgtctacttctgttttctccagctcatctacttgtctcaaaccaactaaatgaccaaaaggaaaagttggaaatggcaccagtggttcatcctgctcattttccagcatagtccgaaggtagacaattctcatactttgcccattttagacagtcttcctcaggatacagatggcaggaaggaaacaggaacctctcagaaatccgatgcagctccttactagatctctattttcaccttctttgcctcttctcaaatgtggatctcaaaataccatctgcttaattgacctaatagcaattgtagtggtagtgctatttgctatcttttctcgagtgcttaccatgttcccaccattattttagcactgttctgtataaataatcagaacaatcccatgaaggggatactataatataatgatcccattttaaaacatgaaaagaaactgaggtagagaacgattacctgtccaaggtctcaaccgtgggagggggtggagcatatgacctgagtaagctgtctagagtctctcgtacactgaaaccaatgcacccttttctcagggctaaacccagctcttggccccagggcaggactagaatatccctggtcctcatgccagaaggcttgtgaatcaaaggctggagcaatggaggagagatggcaacttattgtcacaagccttccctctgttacacttcctctcttcagtccattctccatgcatcatctgaaatgatatttaaaatgcagaaatcagatcacaatacacccctgcctaacactctctaatgagtcctactgcacttagagcaaaatccacaatttgctcagctactatgagcctgctcttgcctgtcttctagtcttcacctcccacctctctacgcatgactctctcagctctaaccacaccggccttctttctattccaggcgcataaggaactgatacccacctcaggacatgactatgtcccactcactccttcgtacattgtcatctcactgtcctcttgttatccttcagatgtcagctcagatgctgcctcctcagacaggcttctgctgaccgcccccctctcttactctaggcatcttattaccctcttctgttttctgtatagcatgtatcccattctgaaaaagtacctcatttattttcgagcctacatgtttattatctctttccgtgctccccacaacccagtctccaaatgtaagctccgtgagagtcaggactttgtgtgttctgtttcgctggtgtgtccctagtgcctagaacttcctggcacataatgagcattcagtaaacatttcacatatgactggctaactgctgagtaaggaaatgagtgaatgaatgaacaatggattaaaaatgtagatactttatcttagacaaaatttggcaacagtagaaatcaagacctttctctgtccagcttatgtgactctgttcaaaattatctcaattgtgtacaatattttgagctacaaacatttttctcctcaaaatctcatttttttcttttatttaggggaaggaaaaggcatagcagttgtttcctgaagcagttgttcccacatacacaagttgacacctcttttagcttttctgaccaagtttcaataatcatacacagaattttagaaataccttcttctggccatcctcccttgactcctgcttttccagtgggagatggagctgggaggtggtggtagaagaagggagagtgttgggggagtgagggaaggacctgtgtgaaaaggattggatttgaccatttagggaagggggacaatatgaaggccctgaaaaccagctattaatgatggggctcatttctgcacaggtaaatatatcagcactcatgccactaagatattttataaaaatgcttcctgaaacaaagtagttacttctaagtttccctagggaataacttttttaaaaattaaaaagatgcattcaacgtatgtgccataaatcctctatttttgataagcactgataactcaaagataatgctgctaatgtatagacaatttactttgttttcttcagagaaattgagaacttaggtcttgctttgtacacaaatacagaggtaacaaattctgataaagatgtgaatcatatttttttccactggttagtagagaggtagattgggaggaaagcattagatgtaatggcagctgtggcccgttcctggatgctaagcaaatctgtttcacatgtgaacatgttgggatcttttacattttgagaccgttttgcccttcttttaaaggtccttatagtctcataactcacagagaattatggtttagtttcagttaccagtaatattgtaaatatattcacatacatttttaaagacattatggcaatgtccttaattaataacatagccatcattttataaagagtcccaatttattaaaaataaaaccctaaaaccaaaaatgatgggataacatctttatgttgcccttgtttgcattcaggatgtttccaagtttatcatgtctgtgacctcagttacgtttacttccccagatggttttttaccacatgagcaattaatataattggagactatgaagtgtttatgtcaaggcaagaagcagtagcagcttcaatgtggtgactttgcaggcagtcaaacatatttcactgtgtgcttccaacctaacccttcccctgcccttccccttctatttttatattaaacagaaaaagagagttcacaaaggtgctcagaaactggcagtttctttcagaatgtggtatatttctaatttccatatatttccttcaagtggaatggccctgggagcacaattaccttcaatcttgacaggtataaaaaggccaatcctgccagtctctgattgaaatgttagatcaacttttctgaatctggcatgatgggtgacaaaagacagggatgttgctgggtcaggtgaagatgttgccataatcccttttacctattttgagcttctgagcaagaaaatcctatatcaaggtacattagcaccacctgctatcagcacccttagagaggctggcaacagagaggttctttaacttttataaccgtgctctacattaggagaggctcaaggaaagaaaaatcaggcataatctctgaagactttataatgagctcatgttctcattcttcatatagattccatttttctgtatgaaaatggtctgccaactgtccataattagccccatcttacttcacctggcaatatctagtgcttatgaattctgttggtagggaatatctttatgtggtgaatgcattctgcaaaaagtatacatcaaaaattgtaaatcatattacatcttaattacagaattgattcctctgaataataagcttataataaagccttgctagggtggtttcatatccttaaatccaaaatattgtgtttgttctttcactatcaatttgtatagactttatgtgacaataggtactctgaaaggggagcacacatatattaatttgcatttgatgacatactttttagaggtgcatttaaggtcttcccatttggtctggcaagttctgtctgcatggatctctcatccccaggatatttttagtgctccctctctgtttcttcctcttatctcccttcagagtccatcttgtcggggaagtcttctccgaccatctcatataaacctcccacccataccatgctttacttttctcctattacttataattacaaggcatattatgaacttattttctatcttccctgaactaaactctataaaactgggttttttctttaacttactgttgtatcttcagacctaggacagtgcctagcacatgtacacacagcacacatcacacacacacacacacactatataatgaatgcatggatatgtgaacaaaatgatgtgcttgagagggaatggtgtctataaaaccgccggtattatcagattcattttgtgtggttatgtttcctgaggagaaagagacgtattactgtttacttttggtttttatgtttatctgttataatagcatatggtatatctggtatatctaactgctcaagtcttaaatgtcttaaaaatattgattaatagatcctttaaataatatgattctaagactcatctgttctgatcatcataatactacaggggaaccacaagtcatcaaatggcatgaaactcaaaactacagaatgtaatctgggagacttataggcccaattttaataaaccacataatgtttttaaaatgtataatttcattgttaacatttgagaaattcagtatattgcacataaatatctggattcccagcctttcttgaatagcctgaacgtctgctgacgcgagacacctatgcctgcatggcatcagttagctggagctgaatgtgggtgtgttgaccgcagtcgccatcacacccttttgtctttccctcaccgcactcctatgtatattttgccaatatggcactgtcagtgtttggtgtggtatccctgctgtaaatcaagctaatccataggcatcacttcatgtgctgctctttatttatttactgaaatggagttgaaaatatttgttgaggttaaggaaaaactatgttctttgttgcactttaaacattctaaatattttggattagagaaaagaaaagggagcttatactaagtttttattttcctgaaaataatccataacttaatgttctatgtactgaaggagtttgggtgttcacaaatacacatatttatcaaaattcaatgaatgaatacttaacatttgtgcatttcattgtatgtaaatgtaatataaagtggaagcaaatgttgaactataattaatcatatgcatgcaaaagtatttaaggagaatttttctgtgtctgaaaatctctttgaaatgtaccaaaatcagatggattaaacaatggattgaaggatggttagattaatagatatgtgataaaagaagcacaatagaatagtcatgggagaatccaggtagtgggtacatcggattttactctacagttctttcaactttgctgcataattgaaaattttataataggatatagggtaaaataatctgcaattaaatatgacaattttcatactgttcctgctttctggaaagtttttttctaaactaaatgtacaattttacataatgaattaatgaaatggtaaattattataattttcagattctgctgtaggtttaattttaaaataatcttttattttaaaacaaccaattatgatttggagatgtaattatgggatttttaaatttttctgtattgtcccttttgtaccttattttcttcctctgtcctatacaatgatcaccccttattctcaaggcatacattccaagacccctagtggatgccagaaaccacagatagcaccaaaccctatatgtattatgttttcctatctgatgatgtaagtgactaatggactggtagtgtatacagagtggacatgctggacaaagtgatgattcaaatcccaggcaggacagaacagaacagcatgaaatttataactagttggcacaacatgcaatttataactatattttcacacaaccactctatctcaaataatattccctggtctctttaagttttacatcttttaagctcctatatgtagtttatgaattaattttaactggttattgttttactctacactttttaaggtgaagccatttaggattttaatgttttaatcatacatagtttttaaaataattggcatattgatataatgaaaagttctgtttttctctcatggactatttcttccatacatttagaaacttctattttacagttataaataggaggttgtagaactattaaaagtaacttaattgtaaatgcagatgctcctcaacttgcaatagggttatatcctgataatcataagttgaaaatatcattaagtcaaaaattttaagatagtattatatcaaaacaccacttacgttacaatatcagatgtctttgaagcacaagtccttctctctgtagataatacttagggaagatcatggatttcatttctcctcgttttctaacatttctctttcctatcagtctcctttgcatccagatgaagtcttatcaaaaagaatttccctcaaacttgtccatatcattacaatttagtagaccccaagtcagtcaattcaactaatattcactaaatgtctatttggctggcttcttcctgggaatctggacacaaataagacattatccctgctctaaaggaagtctcctgctcctataaaaggctaatgtggcaaaaagcagacactgacaaacattaagtggaggaatgttccatgttgatatactatccactttctgatgactcttttcgaaactattgttaggttgataaatatattcttggatatttattattaagtagctgaaataaaaatgattccttcttttttttttttttagaaaatagggtagggctcagcatgtgaattttgtttttaaatcattttaattttactttttatgggtggcagcatagtatggtagaatgagcaaaatgagtttaaaatcagacagattctgtcttctaatcttattaattcagtgatctagatctcagcaacttatttaaatctcccatgtctctcttttttcggctataaggcatgggtaatatagctatatgtgtgagaattaaaattttagtagaataatgagtaaaagtttcgagtccatatggtaggaacccagtaagtagtgagcactcttattattgttgcaatgatgatgatggtgataatgatgatgatttccatttgagttgcttgagaatcacaccctgagacaaagattctcctataagtaatttatgtgagaggtaatctcaaggaacactgataggggagtgaaaaagtagggcagagaaggaaaaaagccaataaggaaggcaactggagcttaatgatgctgtggcattctgagagtcaagtgtacagaatttcccactagagataagggagctggagtatttatccgtcaactcctggcagtcattagttgagggctactctgtgggggtattaattccttggcatttacagccttccacttgcataggcagagtggtgtttggcaggcagagaagctttcaggcaatgaaatacaagtgctaacagttggaagtcagctcggcctgcctgaaatggtaagagctgagggcatatgggtggagcactaatagtatctgtccagatgatgatgatgacgatgagaccacttgatgaagatgggaacactatattcactctctgagagatgaaatgtaagtgtagctgattaaatgtagggagaagcctgtctaggaaaaaagacactgtggtctctgcccactcatacacacaatttaccctacaggtttgagattattcttgcccaggccaatgaatcattttattgggcacagagttctatgcaggtatcctgtctggtacctgggtgggttttgggtattgttggctgctccttggatctgggagtccagttttcattcctctgaactcacttcctaaagctgtgtgcatttagctagcagccttggtctcaggtgatctagtcattacagcctacaggatcagattcagctgtaacccaaaggtcatgagcagaaggaacagctccaccagtcccttgcattgtttgaggagattttttaccatcttccagtttaattatgagatgtggcttctgggcaagaaagcaagtgagatctactttctgcattttgttttgttgataattgaatcatagtaattaagtaatcatgccgggtgtaagcaataacttttatgaacattaagatagtgcatttcataacatctaaatgctttgtttgttaaagttcacttttgagaaattgcaatcagtgttgggaaaacactattaatttgaaggtgtggaagagagagataaggtacctcatttagaattgtatatgtcaggtaactattatctctgggaagcagtgaaggtgtcttatttaataaatctcagaatctatacaagccataaaccagtatttacatatatgggtatagagatatctgtatacatgtgcacatatattattttagccatgttctagacacttaacaaagatgggattgcattgactggccgcttgtagtgtaaaagagaaaatgtaaactgtaatcagtgtttcatttaaatttataaatgcactgtattttttattttgatgaatgggaacaaattattaaggtaataatacattagctataactatgtttaaataagtccagggaatcaggtctccctattaattttcaaagtgtaagatgctatccatccacattgtagatattaggaactgttgaaactctatgtaaatatagtaaaaatttgttgcaaatggaaatatgaagtaattgctagaactttttttttgtattgatagcattaagtattaaggctagctgttgcagtagctataacctagttatagcaatatgcatgtggttgactggtatgtgctttgccacaaaatagaagaaagaatcctccaggagaaatattttgcaaatctgcttttcaacagtaattagaagatgggtgatattttgctactgttcataagtgtttctcttaatattttgactggttcaaaggaaagaagggccaatatccatcatatattgttagggaacatgttttaggattgcagagtgagaaaatagagactacatcttgctatccacattttccacttttctctcagacagatcctgattgtcatccctgtttagcctcctgcctttttactcaactcttccccctacctggatggcttttccttcttttgatcccaactttcccttcctttgatctcagctaaactccttcagttagcctacacttccatcttttattctctcaacttttcttttccatagggtcataattatactgcacataacttgggtatcctctaatcattacaaataatagccattgttcctagcaaaaatgtgtgtttatggcagcaattacattttatgtatctttggttagtccctgcacagtgttagcttatagtaggtgctcacccaatatctgtattttctcttttttttttcaagatctaaatacaattatatttttaaacgttgggtccaggctttacataaaaatatcatcctactttgccccctaagtttctaaaatatcacgtacttttcccccaacatctgcagccatccagaaatttgttggaaacttttttgcattattttaattcctaatccctgcctctttgggctcagtgacaaacaatcaaaaccaccaaaaatgtggttcactcgaagtcagatgagagagcctggctcaattaatcttataggatgtaagcagtgctgcatcaactggctccatgcaggagggacacgtgaaggatctcatcaaccagttatctatataatcctcatgataaatgtgcatgcatggcagaaactgaatcaggtccccataaacaaagtccatcatacagatcacatactcccagatctttgtttctgatctgatctatctcttccagggtcataaatcccttcaggcagatgttgtataaggcttattctttgagctgttgtattttgcttcagtcaactgagctgcaaatcgagtctggctaggtgttggatggtagagcaaaactggaactttttcctgatgtgacagcagtggctcctgatctggctgtctcctcgccagagctagcctggtgggactgagatacgtgaagcagagagatgtcatccgaggagtggaattatcagactgcactgtaattgcttgttgaatcagttatctgttattgcttaacaaaccactccaaaacttggtggcttaaaacaacttactatttcccatgatcctgtagcttggttgggctcagctgggagattctcctcgattgtgtacctgaggtcactcatacagttgcattcagctgagaacttaagaggggctggaatttccaaaatggcttctctttttccagcgtctcctctgtatggctctaatcatcctgcagtctcgtgtggacttggcatcaccatgctgggctccaagatgggggagtgaaagtaccagtcctcctgagggatagagtagtaatcccagatattacttccactgcatttggttgctcaaagcaaatcaaaaggccaactcagaattaaagtgatggtaaaatagactacacctcttgataagaggagaggcaaagccacgtcgcaaaggggcttgtgtaaaaaattggaggaattattggggccatatttggagacttggccccttcacattttgtatctgactttctcataagacttttatttcttcagagcaagggctatgccttcttcacgttttcagaatcagagtatgaaaaatatttgctgtttcttgagtaaatgattactccatgatagttttccctctaccccaactgccaattataaactcagatttacattcagaatactggtgtgaagcatttctactatatctttttttttcaatcattttcaccttttgcatttatcttataaatctaacactataaaatacattatctggccgggcgcggtggctcacgcctgtaatcccagcactttgggaggctgaggcgggcggatcacgaggtcaggagatcgagaccatcccggctaaaacggtgaaaccccgtctctactaaaaatacaaaaaattagccgggcgtagtggcgggcgcctgttgtcccagctacttgggaggctgaggcgggagaatggcgtgaacccgggaggcggagcttgcagtgagccgagatcccgccactgcactccagcctgggcgacagagtgagactccgtctcaaaaaaaaaaaaaaaaaaaaaatacattatcttagttttttttttttagattagaatgctggcaattcactgggaagtgatccctggaagtattaaatgaacagaggagtgggagaagtaaaaaagggaatggatgaggctaaaaaaagggtgacaagcaaattaacctggagcaactggggttgtttctactggggaactctgcacgtgcctcggagctatcccacctgaagggtgagagcactggaggacatgaatttcccagaagttatggtgctccatgattacaggcaaagcaagcccactctagtggccagagagagccctcaggcaaagagacacatgttctagaagtcataccaacagcactgaatggtccaagtcatggagatctgggcagtgcaccagcaatgactgccatgcacaccattctcgtctgagacattatcagagaacaaaccacactcaatttattggtggtatcaagtatctaatgagtttataggctgggctagaatctatatttggggggagaggaggaattacttaagaaggtagtttcttcatatgttctttgacccctttaactgttaatatcatattgtcctaacaaaataatgaaatagaaaaaagtagacctaagaataaatactgtatatactagttttcttttaaattaaaattattaatgtgttttgtaaactgttcttatcacctgttttatatgtaaataagtaatatttttacatcaagcatttttaattgtttattgccttgctgtaaaattgattgttatgattattttagtaatttttatgtgatttcttttaaatcacatagggataattatgcttggcagattacttctacttttttttttcagatgttttcaaggcagagtcagaattaataaattttagccctctgcccaatccatgataagaaggtaagatttagtcattgattcactcagcatttaccaggtatttatcttatgtcagtcactgtgctaggtgctagagatgcaaaaaggaatacaatgtgatctttgcccttgaaaaactcaaatcttagagtcattcaaatatcactgtggtgaaatctcttaatttatcaccattgttagtaatgcatagtattactgacacattgataaccattttcatatcaatcacacctttttataaccataaccattttcatatgaattacaccttttttttttttttaagatggagtcttgctctgtcacccaggctggagtgcagtggtgccatcttggctcactgcaacctccacctcccaggttcaagcaattcttctgcctcctgagtagctgggattacaggcgggtgccaccatgtccagctaatttttgtatttttagtatagacggggtttcaccatgttggccagtctggtctggaactcctgacctcaggtgatccgcctgcctcggcttcccaaagtgttgggattacaggtgtgagccactgcacccagcccaattacacctttaagcccatgtagtcaatcattcagctccacctctaatttaatggccttcctttccctgtcccttccttcccttccctgtctcttccttcactttccttcccttctctttctgctatagactgaatgtttgtgtccctctgaaaatttttatgttgaaatcctaataccctatgtgattgtattaggaggtggggcctttggaagataattaggtcatttggagacctccctccctcttcagccatgcgaggtcacagtgagaagagaagacataagtctgtgaaccagaaagcagtctctcaccagacaccaaatctgccagtgccttgaacttagacgttcctaccaccagaactgtgagaaataaatttccccctcctactaaatagttttagctaaaaggagtaccaagaaaagccctgtctcctatttggaaagaaacataagggctttggactctaaattcacaaaagcagcatttatagtttacatctattgttgcacatcattgtaactccagtgcctggaaaagtatctgatcatagtcagtattcaatggccttaggtggaaactgaaagcaaggaggcatagtagagtgtgattagaggtgttgactggagatttgcatgttttatcagtagcagtttttttttttttttgaggcctaatgatgctctgcttcctcatgaatttcattccaaatgaagacagtaactaattgcattattttttgaactgcttatatttgctgttaccctttcttttatgcagaagatattcaagttggagagggaaattatgatttttttttcctttttcaatgaatgtaactgttaataggtttggatgagtaacttctgtgatataaggtctccgtacaagcagttatcatgctctgtcagtctttctatgcaattttatcatgtagattgttttgggaaacatgaaaattaagatttaatttgtcctaggaattggatccaaaatgtaatggaattggttccttaatgcagtgcatagttgtagagtatagtgtaaattaaatcaacttgtgcttcaataatctctttattagttttcaaatattgatttaaataatgatattaaattgtgtatagttgaaaagatggcattgctttcactgcaatagatgaatgtcatgaaaatgttcttctcttgtaatggaatcagatgtagaacatgataaagaacagttctcttcacacctcataatttctgacatagtaagttatgttgaggaaaataggcacattatattgacaatatatttttgtttacaaatatgccaggtggcctggtgtacagattgattgagggtgatcactactgcccatcacaactattaccttttgcaaagatggccgaagtggaagggaaaacttccctgcacaacttttgtggtggattactgttgagatatagctatgcattggatgttttggaaaaggaatatataagaatagacctttgtatttattgaggaaaattaaaattataaaagataaaaaggcaacttaatattctctcatttaaattttaattaactttcaattttgaatggtgttttcctgagctgttatccagtttctgctctaaagttggctgtaattttataacattcttttgatgactgtatgtgcatgaatatgtctgtagttattttgaaggtaaaactctacttatttcacttttttgagtgaagtattaaattgttttcaagatagcagtgactgaatattgcacttaatacaaatgtttaatttctttaatcctttttacagataaaagtatatgctttttatccttttccttaaaatgacaaaggcttctcctcagggagatcagaaagcataatgactggcatgctgaacctggtatctgaacatttgttttttattctttatttcatgtgaccttggaataattcagtggctcctagattttctcaaaaatgactcaatttttcattcatttcatttaaatgaccctttgagttatctcgtatgctacctgtttttatctttataatacagtaaaatttaaactattcatatctctatgtgggggtgggggtgggggcagataagggtcatagagaaggcacctctttctcagaaaagtagcaaatgaccaccctccatcccaaaatagatttagctacaagaagagtaaagtgcacatggaagaacaaaaaagccttttggtgtacaaggatttcagactttgttgggcttcagcatcagtagagagtcttattaaaaacactgtcatacatcacttaaagacaaggatatgttctgaaaaaaacagatcattaggcaattatgttgttgtgtgaacatcatagagtgaaccgacaaaagcctagatgggatagcctactatgtacctaggctatatggtatagcctgctgctcctaggctacaaacttgtacagcatgttactgtagtgaatactgtaggcaattgtaacaaaatggtaagtattgtgtgtctaagcatatctaaacatagaaaaggtacagtaaaaatttgacacaaaagattaagaaatggtaattgtgtatagggcacttaccatgaatggagcttgcaggactgaaagttgctttggatgagtcagtgagttagtggtgagtgaatgtgaaggactaggacattgctgtatactactgtagacttttataaacacagtgaacttaggctacgttaaatgtattaaaaatattttttctttccccaataataaattaactatagcttattgtaacttttttatgttatatacttttaattatttttaacttttttactattttgtaataatacttagattaaaacacaaatacattgtacagttgtacaaaatttttttctttatatccttattttataagcttttttctatattaaaatttctttttttttacttaatttttttttgttaaaaactaatacagaaacactcacactagtccaggcatacacaggaccagggtcatcaatatcactgtcttccacctccacatcttttcccagtggaatgtcttcagggccaatacatgcatggaactgtcatctcctatgataatagtgtcttcttctggaatacctcctaaaggacctgcctgaggctgttttctagttaacttttttttttttttttttttagtaagtagaagaattatactctgaaacagcaatcaatagtatggtagatacagaaagcagtaacatagtctttcattatcaattattatgtactgtaaataattgtatgtactatacttttgtatgactggcagcacagtaggtttgtttacatcagtatcattcattgtgctatgatgtcatgatggctatggcatttctatgcaatgggaacttttcagctccactataatcttatgggatcaccttgtatatgcagtccatcaatgatcaaaatgttatgtagtgcatgactgcacctactccaaaactacagaagtggaatttagagtcatgggaagctggataatgaccatcaaagttggtcttacatgaggtaggacctggtccaatttgaagtaagaaatcagggaactttccttcaacacttatttccttccatggtctaagacatttcaaaattctgagcatggttttccatttatcacagagtttaagttactattcagtgttgaaattcctggccctcaatggcattatgaatcagctgttcatagaactcaactttcttgaatgggccatttcccaggtcttctacagctgttttgctcatttttaatcccttcatttgccagcttaatatttgctagctgctgttattggggaattcagtttttcccccatgtccctatcttttgccagtttttctcttcattcctcaaaatcagtagttctcctttctcaaaggttgcctatgaatcatccatgatttgtatatcaccctttgggaaacacgaatattttcagaaccctcatttctctgtcgttaaatgaggtcaataatgactgctgacgtttcctttgactctgaagggcgtggtcaggctagatgagaaaattcttacagaatgtggtgtgctgtgctgctgtcgccactttgctgggagactgaagctcagacagctaagcgatttgccagggctgtgcaacccatctgtggtgggaattccagaattccaacctggagaatctgacttactcttttggagaacattatatttgataaactggaatcattgttttgagtgctcccatggctctgtaggccaaaacagtagaacttatgacagtagtttggtcttcaggaactccacttaaccccaaactaccctccagttttcagagagcactggggaaaagggagggatgagtgtgtattgaattatctgaattctgccacttatgcctaagagatatgtatgagagaatctttacattttgtacacattattctaaaattccttttagtccttaaacaactctcagggggaaaatagtacagaattaaaataaaagttcttaacatttgtccctgaatatatttttagaaaaagtatacttgaaatctgatcacctataaggaaagatttatcaggagagtttaaatttttatatttactcatattaaatgcatgtgtgttttgagaccaaggttttttgtttgttttaatattttggggagacatacttccttcaaatatataggttagaggtagggggtagggatggttagtggtataaaaaaaaacagaaagaatgaataagacatactgtttgatagtacagcaaggtgactgtagtcaacaatgacttaattgtatattttaaaaaactacaagagtgtaattgggttagggtttgtaacacaaagaataaatgcttgaggggagggataccccattctccatgatgtgattattttacattgcatatgcccgtatcaaaacatctcatgtactccacaaacatatacactatgtacccccaaaaacttaaagaatatataagtttaaattagaattcccccaaattctagtagtagaatatattcttttaaaattctagtagaatttgggagaattctaatttaaaccaattctggtgttcctgagttatgtgagctcctccaagttccactgttttgtcattgccaactcagggagtcaaatatgtacttatttagcattttctgagccaggtactggctctgagaggtacatactttcatttaattcttcaagagaattaaaagcaaacggagcccatatgttatagacaaggaaactgaggttctgagatgttgagtagcttactcaaggttgacctgagactctaaattaggttcatcctccttgaagacacctatattccttttgttctcataaaatagcacatccagccagcattccatcccagatattggcactaaggagaggcgtgggaaagggcatggacactttctgttaggtacatgggggacgttgtgctctagcttatacatgactgtaaaggcgcaaatgaaaactcttcctttattagtacattttcttttgcatggttatctgggatgagtatgtggtgaggtggggctgtgggaggaagctgctgcaattagttttgcctcaggtagaatgctgacatcagttgtaatgagattaaaatcttctactcagctgttgcttgaaatattctattgtgttctcatccaactattttaactaattgaagtgacttaaccatataattattttcaaatgtttacaattacttttagataaatataaatgaatgtttgcctgcatatgaacaacaaaaggaataatctggtaccttcacccaaatagtcaaaccctctaagatattggtagaaacatcagagtgtatcagtgaaggtcaaaggacacaaataggcatttttaaatactaaaatgaaatattactttcagttccaccaaaatggagtagcctcattccttccgggttctctcccttataactaaaaatttctagatacagtgctacgaagatggcaaggaagtctctcaaagatcaaaagaagagggtgaactgctaggaatttttggaacttgaactacaaagcagtgagttccttgaatttttgtgttatctgtcatatatcctgagctaggtgctacagaagcctccaaactgccagaactgccagaaagtacagataaagaagctccaagaaagtcttgttttctttaggcaaaggaccaggtgaagggtggctttacaccagaaaatttttggcagtatctgccaaacaccactggaaaactcacatcttactccctccatgatttcagtggtgctaaacagaatttgatcccgtcattcccatacattgatactgttagacttgatgagttacatgggtatattgttattttctagagcagctgctaggaaaactatccaaagcaatatacttttgaaaagataaagaaatcaagatagaaatttttaatatgatcaagtcacccaaaggaaagtaagagaaacagaggaaacaaagagaaaacaagtaataaaatgacagtcttaagccctagtatgttaataaacccaattttattactttaaatttaaatgatctatggaaatgcaagggacccaggatagtttaaacagttttgaaatgaaagaaccaagtttgaatacttagattttctgattttaaaactgtaaaactatggtaatgaagacaacatggggctggcctaaggataaacagatagattgatggaatagaattaagagtccagaaataaagccttccattgatgtccaattgatttgcaaccagagtgccaagacaattcaatgggagaaagaatagtgtttttgacaaatggtactgggttaactggatatccacatgcaaaagaatgaagttagatcccttccttacaccatatataaaaattaactccgaatggatcatagatctaagtggaagaactaaagctataaaactctcagaagaaagcataggtgtaaaattcatgaccttgcgcaatgaattcttagatatgataccaaaagtacaagcactgacaacaaaaagaaagatacatacactggactttatctaaattgaaacttttgtgtttcaaatcacaccacaaagaaagtaaaatacaggtcacaaaatgggagaaaatatttgtaaagcatacatctgataagaaacttgtatccaaaatacataaagtactcatatacctcattaattaaaagacagataacacaattttggattaggcaagggttctgaatagatatttctccatataagttattcaaattgctaataagcacatgaaaagatgctgaacatcattagctctcagggaaatgtaaatcaaaaccacaatgagaagccactttcattcagtaggatagctattaccaaaaaagacagataataagaattgttgaccaagataaggagaaattagaacacttacccattgctggtgggattgtaagatggtgcagtcactgtgaaaaatggtatagcagttcatcaaattgttaaacatagaattactatattagctggcaattctactcataggtatatacccaagagattaaaaaaatttacataaaaacttgcacattaattttcataccagtgttattcataatagccccaaaatggaacaacttaaatgtccatcatctcatgaatggataaacaaaatatatccataaaatggaaaattgttcatgcttaaaaaggaatcaagtactgatacaagacaaatgaactttggaaaacttacgctgaatgaaaaaaaagctagtcataaaagactacatattgtatgattccatttatatgaaatgtctagaataggcaaatctgtagaggccgtaagcagattactgattgttgggggaaatagggagtgaatacaaatggcatgagtttctttggcggatgaagaaaatgttcagaaattgattgtggtgatggttgaaagagtctatgaacatacaaaaaccatttaatcgtgtatttttaaagggcctggtatgtgaatcaataaagctaaaaatgtaaatggtctaaataaactaattaaaagacagattttgacataatagataaaaaacatgacccaaccatatgctgtctataaaaaatttgcttcaaatacaacaatataggtaggtagaaagtaaaagcatggaaaaatatataccatgtaaacatgaatttaagaaaaaaattgttatattcttaccgataaacttcagaggagagaaacattattagagctaaagagagacattgtataattataaaaagaacaatttatcaggaaaacataactattgcaaatgtgtgcacatcaaataatagtgcctggaaatatgtgaagcaaaatgaaacattacatctaaattttcttaaattctttaaaccttactccacgtataatagtctttaattatggcataaactaaaagatttatgtctatactaagtttcattcctgaaagagctgcttctgtctttttatcctcaaaatacaatactgtattaggtattgaagtgtttgtgtatgtgtatgtgtgtatttataccatatagacaaggtctatgattctgtaatcatagaacttacagtgatgtgatccttttcaagcttcatattataacacacacacagacacaaagattcacaaatgtactgaatcgatttaattccatgagttgtaacgttcttgataccatatttgttctaaagcagcatttcttagtaattaaaatgaatgagaagatctctacctaaagagatagtatgaactttaaaagcagaagcagagttcagtatttatatttggtagcaataaactacctgttagaaatatttatcaagtgaagatataattgcctgctttgtctgtgaacctcataagtacaaaaattgtgttctttgaatttacactttttaagggatgtatgttaaacattttagcagtgtatttttttaaattaaaatatatgaatttaatttacacaaataatttattttacataaaaacattctagctagcatctagcagttttaataccttatacattttaatcatatctgctagaacaagtaatctctagagtggtcagctatggaagaggataaagttagtagacctactaactttatagctcatatatattttggttatatactcgaattcctattactcgatgcttcaagcattatcttttaacctctgtatacaaaattagaatgtcagcacgtttacacttttctacttgttctccctctactttctgtttttataacttactgatactaaaatgttcaaagcttatagtatttttatgttctgtaactataattctcacacttttttctttagttatatacataaatcattttagggctgacctccaaatttttacaatagactctccattctataagttgactggaataatttctaacaacatgaatcatgcatgacttgtacataccctttgggaaataccaggattctcagaggttttacttgtgtcattaaatggagactgtaatggctgctaccatttctcttctctgtctctccggtgtgaaacagggctcaggggtacacataaggctgcaatctggtcctttttcttttctctatctattcacatttctctttgttttgacctcctgaatgtgaaaatgtttaatagcatgtatatttacatatttaagtattcaagctctactgcttagttcttaatagtatcttacctgtgcattttcaccagccaaagattttgagaggacaaaagaggggacaagaacttgctatccgttttaaagaattttctatagagaccttttaaaagtaagatgattaggatttcattaaaaagaattttaaatatgttaaaagcatgagtttttgcagctgctaggcagaaagacttgcttgctaaccacactttgtttcttgggaatgaatgactgtacttaatgtacacacacacacacacacacacacacacacaggtgcacgcatgtgtgtatacatgcccggatatacaggaactaaagataggataaaaaactgacctctagaatattcagatacagacatcattctgtggctgcctcaccaaatcatatgtggttggatataagaaagtacagcctatttctgggatttacagagataagaaaagggaaaaataggaaattttaaaatgtcacaactcattttattaatgattattactcagctttattattttagatagtaatgcatttcatgtttgaatatcacaaagaaaacttttctgaagtgattttcttgagaatattgttatacatgttttctgcatcctcccataggtctatgaacataagagtttatcatattttacctatcctgttaccactacctgtggacagtgttaattgatttctaggaaatgccgacacttattttagcactaatttcacagagtcatttatttccaaggtttatataacagtaaataaactaataaaatatattgaattttaatttgcctttttacctcttaatttctctcttatgaatagactttagaatttgaccttattaatatactaggaaactcagaaattagtttcatgaaataatgtttgatttattttcattcatttgataggacaggagctttaacagatggactgtcagatccaaataaagttttattgctttattgttatgtgcaataattaagatattgttcagatagattgacacctagactctgggagacttatggtgtggtggtgtctagatagaggtatatggagaattcgtaatactgcatgtgtaccaaagaacacctgtattgttataatttgtatgtaaattgtatatgaacaattgtttataatctaaagtaatattatttagaagcattttattacatttatttttagatttgtaacctgattagaagactaactttttcaaatttttctttttaaatgtcttgatttttgagaaattttagttcactcttaagttcccttaagattatggagtagaaaccactgtaagcttaggaaaatattttgaaataatttgtgaaatacctttttgtatcccaataatttctattgtcatgagcttttgaatgttaacaaaatgattttcatctctatgttaggtttaggtgcagggtatacaaatgttatatttttattttcagtacagtacaggattctacaggggttttcattgttcatttggggggtaaactttttatttccttttctaatagctaagaggtataaattttgatggtattattatctcagtttacatatgtttcacttgtaaatattgcattcatgaagaagaaacaccacaacaatttaaacacataaaatacttcatgtgagttacttgaaaatgacaaatcgaaatctgtcacgtaataggaaaactatgctttgaagcataatctctagtgctgcctcttctctattacagcttaaactgtactctgcatgtcatacataaagaatgaactttgcagtcagttaaaaaagctgaaacaattggtatgagaaacataccaagaaaatattctaatcataattccaagttgaggtcaaaaaaataaataaaccagaatatgagccataatctttttattttttttaactttaatagtccttagcaataatcaacaatttactgattcaacaggagacatgttactctactgccatctggttattctaaatagaacctatccctctggacgagcaaaaggcgtaatgattggatagacgttttggcagaaaaaagacttttttaatgtcttgggatttgggaggtaaaaccaatggccataattttgaaacatctgctcttttcatgatctcgtctacatggaaagagatttggaaacagaacatcctcaagcattatttttttgcagtgataaaaaaatttcattttgtctaaatatgtaagtagagtcaaattcacttcttagtaaaacctattataccattatataaacatgtagcttgcttcttcttttgaattcaacattatcttaagttggtatatttattgtttatacatctacctacaaccaaaaaggtgaggagttttacacaaaaagagtatagatataatttttaaaaattgttaagtaacacttgacagcaaaaggatgattgcacccacaacacatttgtcagggatagcaactgtagttggcaacaaaaatgaggcctatatgctccaaccctgggtcatctttctactgtttgaaattggtatccaactatctattggatgaatgtccttcttatggaaataagaagtgagattttcagtcaatcaccctagaccctaaattggttaaatttaaaaatgaatgggcctgctctcctccttcttgctgggtctcttggcttcctgggttgtttccatcctttctcattctttctttcccctcagagtcagggactctagaggaaaacctttctctggatttgttgcctgtcgtgttcttgccagtcctcttctggggatatgctagattctggttttgtgctcttttgccttgcttagtatgaacttatggaaatttggtctggtctgagctttctgagccctgtgtctgccccattcctcctggatctgatttaccttctatctcagcattggcataaaatgagtcaggacctgcagtcacacctttacttgggctagattagactgtagaccttaccattgcaggagtagggtggaattgacctcaattctgccctcacattccagccctcctaattgattttccaccagcatcttccccaggttgttccctcctcctctgcctgtatgactgactggcagcatgaagctagggtacgttagtccctggtagggggcaaagttcttgcacaagtttccaggaagccaagtccaaaagaaaaaaagacacaagagtatggtaatatgcaggggagaaagaacgtctccaaaagggaatggaatttatttttagatctagaaaaatgtcttcattattttaataagtaaaatatttaaacgttagcagttataagcaccactacatatctattagagtggctaagattgaaatatgctgacagtaccaaagtctggtgagagtgcagagaaactggacatcaaggagtttggcagttactctttttaaaaagaaaaaaaattagttaaactttttattttgagataattgttggttcatatgcagttgtaaggaacaatgagatcccatttatgcttgactcagtttcccccaatggtaacattttctgaattacagttcaatatcaattctataatttctatttggttctttttttataagttctatttcttttcaaataaattctagtttttcatttgtaaagctatatagtgcagtatcactgccaggttattaacattgacagtcaagctatgcaatcctatcaaattaccaacatcgtttttcccagaattagaaaaaacaatcctaaaattcatgtggaatcaaaaaagaacctgaatagtgaaagcaatcgtaagcaaaaaggataaagctggtggtgttacattacttgacttctaactatactacaaggtatagtacccaaaacagcatggtactggtataaaactagacacagatcaatggaacagaaagagaacccaaaaataaggctacatacctacaagtacctgatatttgataaagtcaacacagatatacactggggaatgaacatcttattcaataaatggtgctgggagaattggagaaccgtatgcagaagaatgaaactggacccctatcttgtactgtatataaaaattaactaaatatggaccaaagacttaaatgtaagaccaaaaccaataaaagtcccagaagaaaacctaggaaaaactctattggatattgtcctaagcatagacaaagagtttatgactaagtcctcagaaaaacaacaaaaacgaaaatagaaaaattagacttaattaaatgcaaaagcttctgcacagctaaagaaataattaacagagtaaaaagacaacatatagaatgggagaaaatatttgcaaacaatgcatctggacaaaggtctaatatccagaatctacaaagaactcaaataactcaacaagaaaaaaacaaataactctgttaaaaagtgggcaaaggacatgaacagacatatttcaaaagaagacatacaagcacccaacaaacatgaaaaaatgctcaacatcactaatcatcagggaaatgcaaattaaagccacaataccatttcacaacagtcagaatagctattaaaaagtcaaaagcaatacatgttggcaaggatgtagagaaaagaaaattcttatacactgtcggtgggaaggtaaattgtgcaacctctttagaaaactgtggagatttctcaaagaactaaaaatagaactatcatactatccatgtatcctacttctgggtatgtatccaaaggaaaataaatcattatatcaaaaagacccctgtgttcatatgcttattgcagcaccattcacaaaagcagagtcatggaatcaacctaaatgttgatcgaggaatgactggataaaaatatggcatatatataccatggaatactactctgccataaaaaagaatgaaatcatgtcttttgcagcaacatggatagaacaggagaccattatcctaactgaaatgactcagaaacagaaagtcaaaaaccacatgttctcacttacaggtgagagctaaacaatggacatacatggacatgcagagtggaataatagacattgtggactccaaatggtgggaagatgggaaggtgagaaggggccaagggataaaatactacctattgggtacaatgtgcactatttgggtgataggtacaacaaaagcccaggctttaccactacaccctatatccatgtaacacaactgaacttatactcctgaatctataaaaatgtaaaaaaaaaaatttttttttaaaacgtaacactttcatcaccacaaggattcctcttgttttccttttgtagccacattcatttccctcccacccctccctctctttaaaccttttgtcatttcaagaatgttatataaatagaaggatataatgtaaacctttgggattggcttttttcccctcagcatgaatctcggaaaattcctctagattgttgcatgtttcaatagttggttcttacaagtcctaaactattctaaaatcaaaatttgtcaacaataatatttttaaacagtgctaacgtaacaatgttattaaagttcttaaaaaatgttgaaattttcttctacataaaaagttaaacattttatatggtgtgttgattattctccatttactctcctcctactctaagtccccctgcctttctctggcttgctgcatgacccaaggggcttacttttatgcagtgtatcatctgggcccctcctcttccacatatccggctcaacagagtttagttccttcctttctttttacccctaagacctagaggttgagacagcattttcttattgttggaagatttgttgatgcctttaatcttcctgcatctttggacatggctcctttatttaattcctttcactcaaagttaaaagcctttgagtgtactatctgtttcctgccaggaccctgatacatttaacaaaaaatagataaattggatgacaaatgatatactgggcaaatatttgtaactcgtgtgataaatataggtttattttccataatatacaaagagttcctacaaaaggaaaataaaaaaccaaatgaccaaaagaaaaatgggcaaagggcatgaacaagcatgttacagaagacaaattccaaatggtcaataaacgtgaaaatatgcttctgcattagtattcagagaaattcgtatttctgtagtcctagctactgggaaggctgagtcaggaggatcacttgagcccaggagttctaggcttctgtgtgttatgatcatgcttataaatagccaatgcactccagcttggcagcataacaggtccccacctcaaaaaaaaaattaggattgctgagtcaaaagttatgtgtttgtctttttaactgattatgtgagattgctttaaaaagacattgcaacaatttacactaaagcaacaagatacatttttcaaccgtaagatgggtcagattcccctttaggactgaagcactctcccttctgctgagagtttggtcaggcaataattttcagctgattccttctccaagaattttcctcagagacagctgccttgcctaagattatggcctctccctgaggatggcctgccagcaattactcatgatgtaacatacgaaagtccaactgccttgcctgtaggttggaaaactctaaagggctattttccagggaacccaaaccacagcacagcattaacacttaccatgtgtaatccttaggaacataggaattctaatagtataaattgttgcaatgtctttttaaagcaatctcacataatcagttaaaaagacaaacacataaattttgactcagcgattctaatttttttttttgaggtggggtcctgttattttgcccaagctggagtgcagtgactatttataagcatgatcattgcacacagaagcctggaactcctgggctccagtgatccttttgcctcagactccctagtagctaggactacaggtgtgtgccaccacacctggctttagcaatcctaattgtcagaatatttgagaattaaaaattagaaagcattagtacataaatatatatatgtataaatgatgtgcactgctattttatttgttggaataactgaaaaaggcttaaatatccatcaatagatgaatgatctaccaatagaggatattgtatgttgggatattttgatagtattaaaaagaatgagctagatccatatttaatgggatgtggaggatgtccaaatgtcaatgatacagtgttgtataaaaataaaagaagaaaaacaagttatagatttatgttggcttgtgtgcatgcgtgtgccctgctatagcttattaaaggtcaacagatctcagtgactgttagaatgacgtgttttattgggctcactcttcagccagaacatgctagcatggctatacttgttatttatggtgatgaccattttgattggctgggtattttttctaattaggcagtgcctgtgctgtccttgttgttaattattttgatggttggctcctcctttaaagtgtattgtcagctgactgacaatttttgaaagcctgtttatgtagttggcttcagaagcagcaaggattcaataaaccacttttatattcagattatgccagatatttggatggaaaagggagtattcattccagatattatatctgtataacaaatataaacaagttagaattataatcaaaacttctaattctatctgttaagctctttgtagacactccctcttcattatgaataacataggtaaggagagagaaattatgcattatatagttaaacactggcaaaacattatttctcattctcctactattggcttctgggttaccagagcacatacttaggactgccaaattctgaagtttagaaaacactgtcataaggcataatgtatccattagaaatgcattaggaaaagagagaagtaacattttattagggcttttagctagttggtggagtaataagcatacttttgtgttacctttatatgatttatattacttttcttctagagaaaacagtggaatcaaagagtattttgatcagttttataaagaaatagatgactacttaagaaataaatatattcaggttagagtttgctcatttgtatttgatatgatctgacactgcagaaggccaaaggatctcattattgcccgggtctttacaagaaaggttccccaatgcatgacatggcaatttgtcgcctttatttagagggatttagacaaagcttgcagcatttagcattccgttcctttgacagtaccttttaacatccttcttattgttctatttgtgggtcaatgcaaagcattcatgaagattttgtggtttagggagcaagtgaggctgttgtctaatttgttgtaattgctcaacttactcaaatagtttaatttacctctgaatatgttcagcagcttagaagaaaggtgtttgttcaaacatgaaatctttataattagaaaaaaattattatatgggtttgtgttatgtaaaccttagtgaactttctcccaatctaatttaattaatctttaaataacattggtttagttcttttggcataggggcaaggaaatattatgctttgaaaatgtaggcttttctgagaagtaacatacatttttctacgtgagcgactttttccttaaatctctttctaaacagtcatttcaacttctgcctgagggaatggattagctgtatcattcctcactctcagattaaccccctccctgcaaactgctacagccccagtcagcattaaggttaccaaaccatgagggaggacacaaaatgttctttctctttccaactcaatctatctttgaagtgccaaggagagatattctggcagtacgtaaatctgaaattctgttttgcttcaaaaaaacaaaaatgaaattctcactcagccatgattctcttacaaccggcaatctttttctgtcctttgtctacctcagtgtcttggaggtgtctcattagtgggctggtatttctgacagaatgctttttaagagttacatttctagctaaatctatgctgcatttttagagacaaaatagcatacagggaaaatgaaaaataacaccagagtcttgaataatatcgttagctcaccttccatcagttaattgtatttcttctcttaaaaaaaactattaaaacttcaatttcacattatattgctttcacaaatacattggctaatagtatagatattgagccattactgaaaatgaatttttgtgggtagaatttgcaaccaggaagaatattaaaaaactgaatactttgtattcctgtgtgcctattcagtatcctccacaacccagcatcattctttggtgaagaaattgtttactatacttgggttagcaacatttaggtccccccaccttttttttttctctttcaatttttagggatgctgaaattaggtgtgagtgttgataatgactgtttctgcctctgcttatataatcaaagtaaaatggagttaggttaagttattttagagggagcttactatcttctgtgtggccaaatttatccaggagcttaaactttagatactttgggtcccgggactagcatagactgtgaagcgtagagctgtgaaagaatttggatcctaagggaaaaaagtttggaaaccaaccatagaaaatgcaagtgcaaaccacaaagaatagttaaaatgaaaaaaaaggggcagtgtaaagcatgggaggaactgagattcttttcctctgctgttggaagttctaccacatcagaaacatatttggtaatagaactaaagctaaatatatagctatcctctaactagcaattccatttctaagtctataaccaacagaaatgaatctatatgttcatcaacatgtgcaagaatgtgcatagctgcacttagtaatagtcccaaagtggaaacaacagtacaatagatgcattaattgtggtacactattacaaaaaatacagaaaaaaggatgagacaactgtacgtatatacaacggcatggattaatttcacaagctcaatgttgagtgaaagaaaccactggataccagtaagaacattctattgttcaatttgtgtaaacttcaaaagcaggttaaactgatctgtggtgttgtaagttaggatggtggttagcattattgttggagggtgagtagtaatgacaagaagaggaccttcttgagtgctggtggtctgtttcttgatctaggtgttggttacctgagtatgttcactttatgatttgtacaatttgctgtgtgtgtgtttactccaataagaaagattaaaaagaaagaaggaagaaaaatcagctatagaaatgaagaggattggcagtgtaaaagtgtcatttttttttccccatggtaaaagattaagaaagagatacatgattaaagccaatgaaaatttgggagtcaaagttttaaactctcttagcagccaaactaattgtttgaataaaatgcatgctagttatcacagtgtttcaaactttcctgatccttagaacactaaggaagatagtctcaaaaatatttactccctggtccttctgtgggagatttcagtttagtctgtttaagatggggctaggaatctttattttaaaaacacaacttagacaagaattagaataatggtcagttcaaaagagggaaacagaattatgtgatttttttttacagcagccaagaatgatgtagcctggtttattcctacttctccttcatctaccccaatcctcccacgtatctccaattccaatttgagcagtgattctgaaactttactttaagcacttgttaagaatgcagatatcttggccttactccaaggattttgaattggtaagtctgaggagaggcccaaatagggctatgcatttttcataagtaccttcgaagatgctcagattcagaagcagttggtctcagatgtacaccttgagaaagtcaggcctggagaaaaagaatgtactagacaaacagatatatttggcttagtttttttcctttcatgactgggctggttatctagcactggttatatttaagtccctaataaattttaaggtcataggagatgaggagtgtatcttatatccttcttaggagcaatttcacagcacctgtaattgtactgcttagccagtaggtatttttgaaagtcatgaagtccagatgattaaagttatttttagttttattataatcatggttggaaattaacctggaaagcactgagtttccctgtgtgtatatatatcacttgtaattaaaaagtaatctatttccccagtcattaaatgtttattgagtatctattatgtactggttttctgaaatatcattttgtccctgtcatttcatggtctctagttggagcatgcgtagcaaagaaaattcatgttccaaaatggcacaaggagggtcttaagcatttttaatattccacttatcagaattggaatatagataagtatttgcctgctcccagttctttgataggcattctattaaaatcaaaggcaaatgaattgtcagaaatagatttagcttacaatatagatccactagtccttgcaagttggagtcacgggctagttctacaattaagaaagaccaattattcaatctcttagaaacttagcttacctaataccttgtctttatgtattatgtaattgtttttattctaggagaaggtactttattagttcaagactgcccagatatacagtaatgaaaaagaagaaaaaggctatcatcactctaataaaatgattagttatgttcggtttggaagtgtttgctcaatatattttgtcatagacagcataggatcccagacctcttgacatttctttgccacctagattttatagtcctgctggtacgtgcaagcaccttaaagaagaggctaatactggggaacactaaggtatatatatttattatatcatctctatttttaaagtataggccaatcatatatggatttctctgtaaaatgaaatagtatgagagtatcatagagatcagttggtgttcatttttgaagaatcttgacattgaatttaaatatttacagcctggagcaattaggattctcaaatattgctgatgagaaagtaaattagtgtaaccactttggaaaactgacattagctactaaagctgaacatatacctatacctaccctatgaacagcagtgttactcctaggtgtatactcaagaaaaatatgtgaaatattcagcagaagactgcataagaatctcgatggcagcaagtactctaatctcaaccaatagtagaaaagataaataaattgaatgaaaatgaatagtctctaactacacttaatatggatgaatctcacagacataatattgagaaaatgaagttagatgttaaaaagtatattctttgtgattctgttattcaaaaatagacaaaactaatctcaggatagtggttaccattgggggtttgtattgtgactggaagttggcatgaggaaggattttgggggaatagtgattttctgggttttgatgctggttagaatggtgtgttcagcacatgaaaattcactgggctgtgtacttatgatcagtgctaatatataatactccaataaaatatttaaagatattttaacatattaaatattaaatattaaagatattttaataatataaaatatataaagatatgaattggaatcagtttccagtgtttatcagttaggcttgtttacatgcacctacttgagaatttgccagcctcagagaaaagtagagaatagtctaagtataaacaatatcatttagatgtcatgaaatagccttttttttcccttttgcatagtgtttagtgtgtgatatgaaggtgttgtagccaggtggaataacatcaggatttggtatcattagatcatatttgagttctagctctctccttaaaacactgtgaggtcttgggcccagtcacttaattttctgatttgaaaactgagtatagtaatacctaagactttataggtctatggaattatgtattattttatataatgtttgtttactagaatgcaaatctcatgggggcagtgatttctgtctgtttcattgattgtggtatgccaagttcctggatctgtgtctggcaagtaatcagcacttactatatatttaagtgaataaattactaaaacaaaaatatagaaagaactaaaatagaaaataaagtatctacgtacattttagctgctgctcttttaaactttattaaaagtcactggaaacctgagacttgttgagtttaaaatattatggataaagggtaggattaggccttagagaaaagatattattttttttttcagatatacttgtcaaaatggatgtttctttattcaggtgttccttctaggatgatagaatcctgggtcctagagagaatacttagtgctatactgccatctttttgaaagtattccatacctcacaacagagtagactgttgaaaaagtcacaaaacaactgtacttactgaaaaattagatctttacaccatatatccaaaaaatgtatagctgctggttaaacccatccaaagtccagctttgccttagttcactggtaggagccaagctaggacgggttccagaagaagagttccaaagtccagaggaatggcttgttccagttatgggatcccttatatcgaggctcagctgtgacttatctccctgaaaaggtagcaccaccttcttcagggttgactttttgagcacatgaagtagtagccttaaccacgtggagctgatcttccaagagggcctgatgctttcaaggtcccataaggcatagagataatcaagaacgacactgctgcctgtgagacagtgccgtttctccatggtggtcaggtgccaggtctgtgagcaggagacattcctgaggctgttttccctgtaccagctcaggctctgtatcttctttctgctctcgttgctccttgggctcagacctctgctacttgcctggacttccacttgaatttttccatcgtcttgaattgactcattcagagtgttacccagtcttgttctattgaaccttactctctcagctgcatctcaaatcaaaccatagcatttaccctgccattcattcattcattcattcattcatctaatatatgctaaggtctgtagggataattggcaataaatataagcagttatctgaggctctttgtcctggctgcagtgcctcctgcttaagtcctgcagagcccataacagtctaggtttttctgatgctcttttcacttgccccctagtattctggctaaggcacattaatgatgtacacaaaactgttttctcagtctcttgcattttgggagtgattgaaaaattacatatataaattataaaatatattattatgaaatatattataaaacatatgcaaaaacatacaaaatataatatatcacattttataaatattcacggccgggcgcggtggctcacgcctgtaatcccagcactttgggaggccggggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaaaaaaatattcacaaagtttttggtctctgcacccctttccacttttaaaaatgatagaaaactgcaaagagttttgtttattgtattatatatagcaatatttaccaaattggaaattaaactgataaaatttaaaatatttatttactaattaccttaatataataaacccattatattagtataaataacttatttttaatgaaaaataactgtgttttcccaatgaaaaaatttagtacaaagggtggcatcattttacagttttgcaaaacactttaatgtctggcttaataaaagacagttggattcttatatctgtttccatatttaatttgttgtgctatcacacatcccgtaacctctggaaaacaccactgtacactcttgagatatgaggatgaaaaagttaaatgatgtcttagtatttatatgaaaatggctttgacttgtgggctccctgaaatagtgtcaggaatgcccaggggtccctggaccacatgttagaaatgatgccagaaactcacaattttatttattccttgttacactgcattcgatcaattgaattttagtgagtattcattcaaagaatcttagtagtcctccttctaataagaaaatagtttattaatgttggcatatgtacattttataaataaaattttaatattcattattaatgtaggaaaaaattatagtgccctgttacttagagctttatttggatgaaggatgtattaaatgtaattttaaaaagaaaatgttctacacaggtcaatgacctttataataaacacattttattgcttaaatttagtgcagtaagattaccaagacaaatatttatctttctgtcgaacaatactaataatgctgcaattaattatagaacttatttgaagagagttgcatttatattaaaatacctgcctatatcatgggcacctaaatatatagttgtcttcattatcacattggagagcctaggttcctcatgttttgtaaaataatgattttttcacaggcacacgatcttttagatagcatgcatcaggaagaggtaccagcatgctagtttcttatttaagattccccagccccacgactggtatttatgaaagagaagaaaggatgtcattacttgttcctcaagatgacacagagaggtttatgctgcttgagcagaggcttcagaatgtgaagactcaggcccaggttttgatgtgatttgatggccagtagcaacagagctgccactcttcatggatgattaaagacaaagagagtgagatggcatgaaccacaaagccctgctgccacctgacagatttttcctccgattcaaggaagcccttatgagagcccctttatgtgagcctggttcccttgccagtctatttcaaatttttttaatctctgctactggattgaaagtgtaactgccactttcaatatgcttcagaactgctaatggcaaagttgcttttgggaaccagttgattaatttagacaatgcaaaatatggaggtcccaagtcaagaataagctaaacgactttgccttatttggatataattaaaaggcatggatccaacgtaaatgtgtcacttcccagtgacatctgcactttctgtttgcaaacactgttatataagggctctcagaggtcaagagtgcagaggccacccccttttaaaacttctggtatattataaaaatggagaaatgaaaaagcagtgttaaaaaggaattttattttcagggcttatattggaagaaataatgctttaaacacaaattataatgcaatagaacttgggtattctcaaagtaattacaggatttatttgaacctatctttagtaaagtttgttactcaaactttataaatatacctaatagtagtcatgagtttgaattgtatggtaaataccatgttcttttgatctagtcagaatattccagttatttgagtgaatagcctcatttggagataaatcttaaacttgagtttctttctgggtgtaattctgaaatgatagggtcttctgcttcatcttaaaggagtgacatcacttcatccaaaagcagatactatttaaggtgatggttttaaatctaaggccactggatggccaaatcattgaggatataatattaaaacaaagagagattttaaaattctaaaatgctatatgtgagtatcttataaatgaaatccagaaatatgccaacagttttttcataatatgctcaaccttgagaaaaaccctgtttaatatctaaacatacgtatcaataaataattttacattaagaattactttcctcttgtaaagcgtatatttcaaaaccataattattttaagacctaaaagggattataataacttttcatctaagctttataattgtggttttggaacttaggtaactttttggaactatataagagggactggatgtggtggctcacgcctgtgatcccagcgctttgaggggctgaggtgggagcgattgtttgaggctaggagtttgagaccagcctgggccacagagtgagaccctatctcaaaaaaataaaataaaaaattagccaggcatggtggtgtgtgtctgtagtcccagctactcaggaggctgagggaggacgatcacttgagcccagaaattcaaggttacagtaagctatgatggcaccactacactccagcctgggcgacagagcaagatcatttcttaaaaagaaaaggaaagagaagagaagagaagagaagagaagagaagagaagagaaaacaactatgtaagaaatatctgcttcaagttagaattcagaaaaaattcatgaaactagaaagaaaagtagaagaaatggatatcaattccctcaatgtaagatgaagacacttaggctaaatgactgaattgattcctccatcaagcttcttatagagctagatccagaacccaggatttctgaagtacaacctgttgttctttctagtctatgacttgccaccttcttacaattttacatagtcaggaaatggtatggaactttaaaggctcttccaagaggaaagagaattgtttgtatttaaaaatatatataatatatattatattttatattacacatatatcaatggcaggttttcttttcacaaattgagaaaaaatttagttcatgttcaaatacaacataaaaataataaatataagctattttaaatgcctttatttttatctattttttgatattacagtagtcaggtacaaggaagtttattattacaggcgatatactttcagtgaagagaaaattgtgtgtatgctttattttgtatattgtaggcagggatttttagtgtttcatttaagggagggattgataatccaggtatttttgactgcctctcagatattctttgttaaatgtcatttatttctttaagaatcctgttcagtcaaatatttacttgctttttaacaaataataactcagggcccttcattcctccttttacattattatagagtagaatttcaacaacagtgaacctaattacataagtctttgtttttatcaaagtttttagtgttttgtcagccaaaactctaaaatattacaaccaaatatcagatggatttagttacaagcagttagatttattttttaagtgtgaatgtattacttctgaataaaggaaagagctgatatcggggaaggtaaattcaccgaaacctaaggcagataattcactgtagatggataataatttacttttctatagctttgctattttacagggaggagcgtgtgactctggtttatgtgacttttcagctgtttcttctaagaattccttttttcttctctaaatcttcttaagcttaaatgttcttcccatgtttcttggaagtacttgcaaattttatggaatgcacttctttaaagctgctgctagctaaaagtcctaacccctacattttaccatttcattctattttaattcaggtatttgcccatattaaaaaacataacacattcatttttttttctgggaagcaactgtatccaattctttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaactgtatccaattcttaatacacactctttgacaagtgcaaatgacattttataatcagattgaaaataaatgtttaatacttgctttgtgtgcttttgagggaaaaaccgtttcgatatttgagtaatacattttttgttgattatcacattttgttcttaatagaaagttggtttttcttataaagatgtaatttgattctattaactttgtctttttaaataagttatattttaaaaacttgaaggaaaagcccatttttatgtattgcaatcattttgtatttcaaaatctactttgcatatctttgtatacttgaattaatataaaagcttgataaagagatgagaattaatacactcaacctgtgaggaataaagtagttgtattgttgatttaagcttgttgaatgtgatatctcaggatgctaaagaggcagaccagcaggtttcaggtgattaaagaaagtccctcatcttggaggaacttgaaggaacatgttgctatttaagtggaatctaatcagtaagaagaaaagcttggatgtaaaaagacggaatgtttcatgtcattatttacaaagcaactgaacaaaagcttagcaagataattaagtgccttgatgctaagtagaatttttcaaagcaggttgattagaggtcttcttcaagaaaaaaaaattaaacatctaagtacaaatagtctagttgaaaaggctaactcagttacatagatggagaccagtttgaaagaaaaatcacagtattgtatatggtggctgatgttcacagtgatgcttttaattgctgagcaaaatcccgatcatccctgggtagttatagcactaagagtattttactgtgttttaagtttttgaaaactgaaaatccgtacagacttaatatgcagtggcactgaatgtattattccattatcttggttactccatttttcaattggtctgaataaatagaatttgattctttttcccgttgcctgaaaaaaaaaaaatcaaaagtaaatattatcattctcaatataaaatgttatttgcaactgtcaagcaaaaattggatgtcatgtcttgtatctgcattttgtatttcaagacactcctggtgataacataaggagactggcatgcccaggattgtgctgtgtaaacaaatgctggcaaagccctggcttctcttaagcaggtggtcaggtcaaaacactgatggcagcattatagctaaaaatgaaaactaggaagtcgtgaccttaggacctacttttctaccaaagaaaggaagcttgaagttaacaagtttgtgccaaacacttcagtagacatatgttcttttttcagtgttcttttactgtgttaacattttaatgacctcaagtttacttagtaatgaatactttgggggcaaacatccagtagcagattgcttcatttattaccaatgaatttatttattcagtcagtcattgcagagctttatctctgaagaacacatttgaaaagctaaactgatcctctgctcacctggcagtccactgtgagaatataaaacgagtaactataataccaatctacctgtgggcagtttgcaaaggctgatgtcgtgagtgccatatatgagactctttttgaaatctaaaacaataacccagcccagacattttcagctaaagcatatgatctaaatgcttgaattaaaggaaaaacactttggattatagtccccattagtacttaaaacactcttggttttttcacttgtgctttgcttaagccaatgtgtctcaaccttagctgcatattagaattacctggagaactctaaaaaattctcatgttctagccacactccagaccaatcaaatcagaatctctgattgtagaacttgagcatctatattttgtaaatctctttacctgattccagcgtggagcgaaggttgacaaccactgatttaaccacttgcaatttcttcattcattgtattatttatttttcttggccttttaaaaaacacactgtagcatgacttccttaatttagaatcctgggatagagtttctattttaaaatatcccttttattggaattggactaaggagcattataaaaggccatcatttaggatttatattacttttacattatttaaatatataaaacttagtcactgtggtttgatttctgtggacactttgatggacagagtgcattttaatatgagcattagacatcttttatgctttatttcacattctcccagccgactcttcccatcatccattgctgttgcatcagctgaacagagatataacctgataactcctcaccttagctgtacctgaaactgtttcttcctcggaggtgtgttggctactgctcttgggagtcaggtagtccagtgcatccttatacctgattcagttcttggccaatatgggatgggagcaggtaggagcatgctcttctttctatgtctcaggcagacagttctgaagttattctacacatttcctgatagcatccccagtaagattaaacgtcagttgctcacgttagtcaccagcccaactatacacccttggattggctttcccccttcctgttttacatttacacttcctatcccattcaactctcattctagttttttgggaaccacttctctgaataaactatctgtgcacaagtcctcatctcaagctctgcttttttatttcatacaagctaagacagtatgaaagagaaaaatcatcataggcatgttttagtgcatgctcccttctctattgtgtttttaaaatcacgttatttttctacttaatacattcagtttatcatattatgataagggacactttactcacaaatctcgaatgctggaaaagagccctatccccatgttatctgttaccatgttatccccatgctttcgtctgctgcccttattatcctctgtgagttggttgccttaagatcctcctcctgatgtctcccagcagcgtgacctagattcttgatcagtgtccacaccgaacattcactccaaactgtgcagcaaacattttatagactcaagccacataataggtccataacatcagcataatattaaatggaatgggagagatttttgcagagagaaaaatggtgctaatgcagtgtgatacacttggtgtagtggaaaggcaagcactttacagttagggtcccagtgtagggtaattgtgtcttctgttgcccagaaaataaatacagttaaacatattaataaggaccacccagatatttttttcctccagcattgaaaccaattgccatttctttgttgagcatcagatgtttgaaacatatatatgtgaccattataatgacattgtttgccatgagatactcatataataagaggcacacaggaggaggcacagctcccaaatcacacttactctggggcatacacatcaagtgaaattgtggcaaaaatcctctgcactcttgatcttttctctccgtctgtcactttgtggctgagtgcatgtggttgagtgtgcagaagtactcatggatgatgcaactctcttgtctgagcgtatttccaggctcaggaactaaggacgtgtgactgtagcagatgactctcatgtcttgtgttggatttccttggcctctctctaacttgagaaacagctgcagtggacagttctgtgcaagctcagattcatctcaagctaacagcatttcatctccagcatgagcatgtcttttagcttcctgcccatggccttcttttatgttgctggagttcctaacccacagaccgttaggggccagaataatgaggatgttaatgcctcaaagaccaccatcaatcatcagggtccagaaccttgaataaactccccagcctctcatcatttaggtgggcaaccctgggaggcatctgtacttttctcagcaggtcccaatggattcaagccctagtttcccaaagaagtagcctcagtaatagatctgtatattggcctaatcttcttccctgtgtcattctcctcacaacttcagtctgcttcctgagatcatctcccaaataaacaactgatgtccaggttcttgcctcaggctctgatttcagaggaacactaatgaagagcgatgttaggtcagtaatgtaatctctctgagtcaatacttactcatctatgaaacaggaatattaagatctaccttagaaggttgttgaaaggattagatataatttatataatgcatttatccctatccatggtacatgactcactttaaacactgacaggtgtcttaagagatagacaaatataaatagaaacctaattctaacatgatttctatagagaagacgagaaagagacagagtgaacagacctgaggtgctacatgcatgaatacttgctactggtttccttttatcttcctgaggcagttaccataggcatgatcaatcctcctcagaaccagcctttgcccttgtgttacccggcatgagggtgccctactgttctgctcctccttcccctctctagcaaatgcctccaggaattagggatgcaatttcattttcttagttcactcaccttttaactatgcccattactattccattttattctaaccaatgaattatattctactttcattaagggctttcctatccaggaaactcaagtgggtccaaatttcccacaagcacctcatttacccagcagcgttttgtttagaaattagctcttctatacatagggcatgccgagataactgaagcttatttatttaagttatgcttactttagaaatacaaatattaaaatacaccaattttgtattaagctaaaatatagtaaatgtgggctgtgttttagttagggttgctataataaataccatcgactgggtagcttaaacaacaaacattaatttgtcacgattctggaggctgggtaacccaagatcaaggtgtgggccaattcagtttctggtgagggccctccccctagtttgcagatggccatcttctttttgtattcttgcatggcagagagaaaaagggctattcttcttcttcttataaagacatttcatcatgggggctccaatattatgactaaattacctcccaaaggccccacttccaaataccatcacatatagggcttcaacatttgaaatttggtggggggacacattcagtccacagcattgagtgacaaatctttaaaaattggtgcatctttttagccttcttttatataattcattgagcctaattaaaagtttttaaatttataatttagagttattatacctagcaatccagtgatacctagttgatgagaagttaaactagaaattattgtcagttctgtactagttacttattaaaggcttgttgaataaatcattgaatgatcgaatgaatgatgcatgattcttccctggggtttcttctaactctagaattgtatgattctatgattagcaaatcctttgggaacaaatcttctttcaacaaagttggtctaaggtcctccaggaaggtggaggtgccagtatccttagttgtggactgatgtaattacagctaaggatcatagtttagtttcttttgttggccttgctagagcagcccagttgtggctggggtaagggaacaatagctgagtcccgaagttgacatgctttagccagaatttttacataggcggaacagcgtaattggaaggggatctagcaagtttgtcttggagctgggcatacataaaaacatattgttttttacttagcacatgtgcttcttactggaggtgttaggatttatgaaaattatggagtgctaacatcttcctgatcacactgtgctaccaacataaccccatttccgaagagttaaaattaagccttttagaatcatatgtaaactatgagagtaggttcttactaagggtttctgaggatagcataagaggaatattcaggtgctttagtgcaatgacttgttttagatatagataattatataggtaatctttacagatgtataactatataatatataatgggatatattatatgtattttggctttacttcttcatttataagatatttattgtatatatttgctcaggtaactactgccaataatcaataagtgggacagatatggttttgtgacctcatgaagtgtacagaaaagattaaatatgtaaggtgttcctataccaaagatggaatcattttaaacctaccattgcaaagaaaaatagtttttaaacaaagctgtttttcaaatacaggatcttggtagattaaaagatttatgttgatattacaatattgttaaagaaaatgctgagttttaggtgagatattcaaggtgtgtagctttctatgtaatttccttaacttgaaccaactgttattaagaccttttgaggccaaccatttaaacaccactaggtaacacaaaaaacaatgatatctgtgacattgtatgtatcaaaaattaaatgttataaggacaaccagtgcactaagtaggatacacttgtgatggccttgtttgtgcttattttcttgttttgttttaattctttacattttggagaaaataggagaagattcatgggttggttaccaaaagggaaatgtgaattagtgaagtgagaaacaatatgtatattttcatcttgctaaataaatgtggtctcaagtcttgtgatgaagggcgatgagatactactaagtggctgtgtgtatgtgtgtgtgtgtatgtgtgtgtgtacaatatatctgttagctctaatgatgtgtttgcatattctttgaataaatgactcttttatattcttagaatgttctagataggttgatttaatcagtaacatctttccttaagtttcctaattctagggtgccatgtgaaaagatgcagaagaaaagttatgcttacacagatgacattcaggaatgaatactttctgctataacaataaaaaagtccagtactagtttcaatatcaaaagacgaagagaaatggttatttagaactctgtgcatagaataccaatctggctttctctgtagttaactgattctgaataaagatggtgatttgatcaaatttcaaacattttgaattcctcagaatacccttaattggcacagttttgttctttacaccctttgcttcactcttgctttacaaaagttagtgaataaatgaatgatccatttagtctcccaaagttttgatatactacttttgtcatatctagaatctcacatatattgaggtttattttagaggcttttgttctgtgtcactgtcctgggtccatatatcaactctggattcaaattattttagttactatagcctcataatatttggagaggctgataataccacattactcttctctttcagaaatttccaggattttgacataatatattttttttcagataaacgtagaaattatttcaagtttcaaaatgtattattttcttgtttagtgtattttataatttaatttagagaaactagattttttataatatcaggttttattattcactaacaacacaggttttctcatttctttgtgtctttttaatagcttttatagaactttaaaaattggctgcacacctttatatttgtttctaggtgattactggtgtctattgatattgtgattaaaatgtttgattcattagattttttaccttgatatatagaaatatcattaaatattgcatattcatgttctcataccttagctactttgaattctttttggttatacaattttttcagttaatattttttagttttcttgtgaactattatattgtctgcacttaattagagcttcgtctcattttcacaatttttcaatgaattaattattattgttatattggttagaattgagttgttttatatagcagcatatcactaaataggcattcttagttaagttcagacataaataaaaatgctttgacatttcgtcattaaaaaggtttaatctttttaagttccagggagaaatctttttcagattaagtagatttatttttatttctaggttatgcagaggagaaatgattgttttattaaaatgtataaacagaattattaatacatttatataacacatattaatatacacacattccttcaaatgatttaatttaaagaatttcattagtaaattttataatgttggactatccctgcatttaaaaaaaataaaccctacttgatcatgatacattaatcttttgatgtgttgctatatttttgcatgctgtttttaaaattaattttaaattgagatatagtttacatacaataaaattcacccttttagtatataattccatgaatgttgacaaatgaatacagtggtgttatcaatacccctttaagtgtgttgctttgatttgctaagatttatgattgtagcttctaattctgtaagggaaaaggaccatacttttctattttccaatgttatctgtctttttctggatctggtatcaggcttattttaactttataaaaggaattaagaagatttttatctatgtatatgtttaggaacagtaaataacgggatgatcatctgtttcttaatgattttatagaacctgcttcttcctaggagtaaatctttgaccatcctttcattttctcctcatggtttttccctctggtttttaaatcttcttgagctacttttgattatctctattttcctagaaaatcgttcatttaatttaaattttcagaattactggcaaaaagtttaacaattgtgtaccaatgtatgtttttatttacatttatcttgttctaatgacatctggttaagtgtattttcttctttaccttaataggtcttaaaaattgttttacctatatttttaaaggacagctttacttttataattagctactctttgtcttgctatttagttcttttctggctttgtagtttttctttttttctctgtctggtaatgtcttccacttacactgtatttctgatgtggctggagtgcagtggcgtgcgatctcagctcactgcaacttccgcctcctgggttcaagcacttccctgcctcagcctcccgagtagctgggattacagatggggtttcaccatcttggccagtcttgtcttgaactcatgaccttgtgatacacctgcctcggcctcccaaagtgctgagattacaggtgtgagccaccactcctggccaaggctatatattatctacgttacatgataaacattgtacgacatgagcatgtagcattttataaaaatattcattgacatcatctcacagcttttgatatgtttcttgtcattaatttccaagtaacttataatgctatttttagttgctttacaaaccaataattattagacatttaaaaacatttttgaatgattaaattattttagagaggggatacattcttgtttttatattaattttagtttagtcacattatctcagaaaaaaagtgtcctgtatgactttctgtttctgtatttgaaatcccaatttgaagatctttgtattctaacacatgatgtttaaattgtattatttttgtttgaaaataatgcatttcaggattcatggatttttctcttgttttatgtatatctaatgattaaatcaactttgtattaagtaaatcttataatcactcaattttttatacacttgaatgactaatttctgaaagagttgtgctaaaatcgctattcttttaaaatggtgaatttctccttttttctatctgttattgctttatcagtttttgaagcagtgttagcataacatctcaataagtgagcaatttactatataattatttggttataagttttgtcaaaacatctttcttggtttcattttatgctttttacattgaattctattacatttggtagcaatgttgccatttatacttgctttttgttatccttgtctgttatactattatattttccagttttaacgtttctgtagcatttagttacatatgtagctctagccattctgagagttgctatgttttaataacataatttaaaccatttatatttattataatgactgaaatgtttatacttattcatgacattatattgttggttttctctatactgttttcctctctttggctgtattagacgtggctagccagatgcctgattaagctgaaaatccaggtaaaatctattttaaattcagagagaaaagttctaaccccaaccagctggaaaatggtacatctgtgtgcagttcactaaatgctacatactgctgtatggcatgaattctgcagcactttataaaaatatgccgttctcatatacaaaggtgaacttactgacccttccatctgtgagacatgtgctttgagctgcttttgatatgttggtgaagtgttatattgagccatggcatacatttgtattatagcttcttggggttagaatttaaaactgtggatattagacagttttttctctctctagctctaaaaagaattatatttttaatatttaataatctatatcttttggtaactcttgagctattttgactacattaaggtggtcatacatatgttacccaaactggaatgcttttgatcatgaaaagtgacactgttaataattcatgctggataaacacatatgaactgggaccatctagggcaaaatggaatatagagctgtcctaaccttactagttagaggaaagagatcataggtataacataaatgaaaatttgtactgtcactcatttacccataaaaatacttactaggtaaggtggtaggcagaacattcagcctgggtttagaggtttgtggggcagtaagatttgaattaaagaagagattatgatgctgtggcatggcttaggtaggacacattcaaactcctagcctaccccgtacacttgagtagctgtcagggtgaaactgcaaacagataccttcagaaaagaacatacaaatccagatttatccattttgcatactattttactcatttgtctgttatttacttattgtggtcatgttactatttttcccgtatctgtatattttaataattatcttatattgaatgaccctgcttgcccagtttttctcttttctctactgtaagcaacataaaagaaaatatttcattttatttgtattttctgctcttaactataatattttgcgtatttagatgtgagaaaatgtaatactgtcaggtcatttcttaaagtatggccttgtgtgatcctaaaacattactgagatagtttaagtttcaggtaaatggtggatgattgttacaatcagtattactcaatatattaagtccacattaggtctcaaaatcttaggtctgcatttgattttagagacatacattatggtgtgagtcatttttctataaatcaggtaaaaaatagatacattttgatgttatacgaaactgtatttttctaccatagcagttactaaatatacaaatgatatccttcaagaaagaaatgataaaactgttttaaattcttttatgagtgtattttaattataatctacatataatgttaatagttttcttatttgattagaggaaaattttttgggctaaactttattttattttgaatagtttagtgccattgagcttctttctgtatgtattacaaatttaatacatttaatccattttctccctcattgctttctttcccaaaaggacacaaggctgttaacataattatttggtctggagatgtcagaggcttcgctcaaattattatatatcaactttatttgctctctcttattctgtatagttttctttttgtaaattacgtagtatagctagattggctccctgtaaatatatctcatagcacaagaaatttaaaatatttccagcaatgcctgttttaaaagcgatttcagctgcacctgtgcttaaatctggccacctctagttcagagcaatattcaaacaccaaaagccaatgatgaactggacattactaccccatgtctacaaaggaagaacattaacttaacatagtgtggtgtctagaagaaaatgtacagcctcataaagtttgaggagacgtttttatgcactttaagcttcagtgtaatacctttataagacaggttctgcagagaggggcaatattatcttctcaggctagctagtattacaacacactttcgctgtaatagtcaaacaaacctttattgaaagccaaccatataccaagcagtgttctgggaattctggaaaaatataaaaatatgaaataatttgagatcatgtaattatgtaatgagtgagaatacatttaagtgctacagtacttccaagaagggagagtttagtacttgatcaagaaatttagactgaatgtgaaggtgacaggaaatcattgggcagagaggagaaaagaagatatgctggatagagaggactgcagtggaaggacatggcaaataggaatgcagagggcatgactagacatgcatttgtgttcactagaaattacagttaatggatttggataggaagggtttatttggagttcctcgagaacaaaactaaaaaaatatatacacgatatggttaatagaaggcagtcatgaaggatttttgaatgagaaggttacatgaaactatctgtattttagaaagttaaatatgactatgccatctgtaagctagattggaagaagcagctcaaggatagtagttaacaacatagttgttaagttttaggaacttttgggcatttgatttggtccgctagaagaaaggaacattattgcaaagaggaaatgcatattccttagtgtctctgggtttgtttgtttgtttttctgagacacaatcttgttctgtctcccaggctgaagtgcagtggcgtgattacagctcactgcagccttgacctcctgggctcaagtgatcctcctgcctcagcctcccaagtagctgggaccacaggcgcaggccaccatgactggctaactttttaaaaaagatttttgtagcgacagggccttgccatgtttcccaggctagtctgggtattgtaagttctcactttggagattgattggttttattggtctgcatagggatcatttattagcagtagctacaggaggtccatctcaatgttattaggttacattttctgtactgtaagcaatataaaagaaaatatttcattttatttgtattttctgctcttaactataatattttacatatttagatgtgagaaaatgtaatgctgtcaggtcatttcttaaagtatggccttgtgtgatcctaaaacattactgagatagtttaagtttcaggtaaatggtggatgattgttacaatcagtattactcaatatattaagtctacattaggcctcaaaatcttaggtctgcatttgattttagacacatatattatgctgtgagtcatttttctataaatcaggtaaaatgtaggtacatcttgatgttatacgaaactgtatttttctaccatagcagttactaaatatacaaatgatatccttcaagaaagaaatgataaaacttttaaattcttttatgagtgtgtttttatcttaatctacatatactgttaatagttttcttattcgattagaggaaatttttttgggctaagtttcctataaaaggcagatgtttttaagagtacagattgtgtataataatgaaatgtatctgtgcaagtaacattctgatttgtactttaattgctgtttatatacagtgtgaattaagaataaaacagtgaggtgagggagggaagaaggaatgaggaatataattagcatactcagtagtttggaaatgtaactgttttaattaacagctttgtggtggcaaaacaaacgtgctttgggaaagctaagaataactaggattgtggcatcctccttgggaaaaagttgtttataatcttaatgttttatttccttttggctgacagacaaaagaaaacaaagtatatgaaatatttgtgtcagaagatatttatatgttcagttttaccaattttatgcattattaaaaagatatttacttattaattcaactaaatgccaagcatactacttctactaatattaacctttgtctttgtatccttccagaattgcatttatatatttataagaatatgtatatagagtctatttattcatatttttaaaaaagtgatcacattgaaatcatgttgttttgaaaattgtcttttacttaactagacattaagaatttagaattgtttacttgcatgaatgggtctgattgtcaggtgatttttcagttcaatatttgtccttccctttgtctaaaatggtcttgatttacatttcttagctctaggcatgactagtagatagggctagaaaacaggctttcagagactaagactctcaaacagataaataaatatactaaatgagacatggtaagtgctgttaaagacatgccaatgaagatagtaggagtacaaaggaggagaaactaactttgcctcagggagttgtaaggaactgcaaggaccttctgctgacttttcctctaccctcttcaacctggttcttcacctctgcagtttgttttctctgttttctcctgcctaatactcactcatctgtgatcttttcccttatattttctctcacttaattggcattggtccacttcttttaaatgaaaaaagaagatatttagaaattacaaggcatttatggtttattaaaatatggaaaatgctttttttagaataaaaactaatataacacttcctactcctttgtcataatcaaatagatacgttaaaattgtattaattttttaaaattttccctatctgcaaatatgtggtgtccatcacaatctaagtaagaccatctaaaagtaaaccttaatataacatattttttcatctcttctttaaaataaatacatatgcaatatattatttgttgtggttaagttagaaaatacaaagaagactgggcgcggtggctcacgcctgtaatcccagcactctgggaggccaaggcaggcggatcatgaggtcaggagtttgagaccagcctggccaatatggtgaaaccctgtctctattaaaaatacaaaaattagccgggcatggtagggtgtacctatagacccagatactcgggatgctgaggcaggagaatcgcttgaacccgggaagcggaggttgcagtgagctgagattgcaccactgcactccagcctggatgaaagagcgagactccatctcaaaaaacaaacaaacaaaaactaaataaataagaaaagttatcaaccccaaatttcactgccattatttcaccatacacttttcctgtctttttttccccctctggtataaatatatacatagaaatactaacaacaaacacatttgcataaaaatgggtcaaaccatatgtactgttttatattcagctttgttcactcattcaacaatcaaataaacaactcacaatcaaataaacatctcattagtaattgcacagttgtcttcatttttaatgatagtgttgtaggactctctccttagttcagctaaaagcccgggggtccttgtcacagggccatgaaaaattaggcgtgcagacaatttgaagggtgagcacggtggggtttattggacgaaaaggaaaaaaatacacagtgactctccacaaagccagagttctgctagtgcacttcctgcctggcagactgaacccctgtaccacctaggaagaagaggggccagcctcgtccccgctgcaaacaacgcgaacttctgtggctccatcccagtgtgtactcctcccagtgtgtagcaggtcagttgcagtttttagtttttcccgggaacccccttacacttggctgtctcaataacatagctttctactctgtgactatataaaatttctttaacccctccatatttggttacgtttctaatcactgaccgaattagtaacatctttgtcaagacagctttgcatgtatgtcgagtcgaattttctcttcaggataaattactagacacagaagctctttgtcaaatgttacgcacttttgaaggttcttactacacattgtcgaattgcctcccatgttttgcctacgtatatgctgactagctgttaaaatactgttctgttgaaagacatttatgcatatatgtaatctttatattgtataccggaaccaaattaaataattgaattctatacaaaacatatatattattttgattctttttcacagttaaatggtcccaataacgaggaacattcctatactttacttcagagaggagtttctgtcttcttgtaaatttcccatcaaaatgcaaatacattgcttgaatgggtttaatattagtggatctttttggctttcctatttatgtgtttccacacatacacccacacacatttatatatatatatgtaatttttttattttttagacggagtcgccctctgtggcccaggctggagtgcagtggcacgatctcggctcactgcaagctccgcctcccgggttcacgccattctcctgcctcagcctcccgagtagctgggactacatacaggcgcccgccaccaagcccggctgattttttgtattttttagtagagacggggtttcaccgtgttagccaggatggcctcaatctcctgaccttgtgatcctcccgcctcggcctcccaaagtgctgggattacaggcgtgagccaccgtgcccagcccatatatatgtaattttttaaacatatatatatatatatatatatgctttttctgaaggaatgagcacttatgacttaactaaaatatttttgaggactaatttttttgaatgcatttttttctgtcaattactcataaaatttattattatggcctttttaaaatggagcttttgtctttcttcagtacttttatctacttattctatttaacaataacttaccaaaatattatgtttacttattcacttttattgctatacttacacttttagaagtagcagagtataaagaaatggaatctgaagagccagttttgattccttgatattacacctgctagcttgtgactttagacaagttgctcaacttctttgagattaagtttgcccatctgtaccatggagttaataacacctacctcattgttttgccttaagaatcaaatgaagtatgtttgtacatggggtttgtaatctgtaaaggccttcacaagatgcagcctgttatcatttgaacatttcatatccagaattacttctattgtgtaaattattatgattggaaatttgatgttaagtatcaaaattttaaacatcactacactgaaattttaaaatgaagtgtcatcttttcaaaatgaccgttttatcttacaaatatcatttgcaaataatttctcccttattaacttttattgtagataaaagatatattttattgatgaatattttaaaaagcataaagccattatatttgaggaacaatttttacattcttatttcctttctgaggatgtaagtgatgaattcttgatgaaatagtatcagtattgcttacatacagtggatatattttcattactgtataaataaattactacataaatatttgtttgaaaccaaatacatcttatgtgggaatgaaggcagtttgttgttcttggcttcccatctctgcccaaaaccatttcttaatctcttaatttctaaatacaatagtgtttttgaagaaatatacagggaagagtgctcaaagagtgagttgacttggaagtgtttatttagtcctcaaaaacatgtgcaaaatatcaagaaactttgtcatcttcaaatctggaatcattttagaagatctgctttgaaaattaagcttctaacattaagaaactggcttatccaactatcttgtttcaaggaaaatagaggaggctagttggctgaaatgaaatctggttcattattcactagccttagggataatcacatttaggggaaaggctataattagctcaacttgccttttacctcatgtgtggcaaaatctaattgtttcttctttccttttcctttttttggtaaagtctcctaatattgttctcaacttataaatttcagatttccaaaatattaataaaaaatagagttgtttgcaataattaaacaatatatattgacatgaacatagattcaaaaatttgtatctttaaaatttatactttggtgctgttgattgaacttctcattatactcagttatttattgtactatggctctttgttcaactgtgagtaattaaaaatataatcttacaaagatctccaacataaacaaatctgtgcttctctacctttgtttgccttcttacagcctccagaaaggactgggtttggaagtttattttaattagagtttaagagtaatgaacattaattacagtcaaacatatggacattcccagaagcatttctacaagcactatgttcattggcagactcacgcaaacttcatgatcatattaaaaattcttcctgcttaagaccattttgcttaggcatgtgcaagtttccctcgtattttttctgatatttgtggtttaaaatgtaaaacaaaagttttatcttctttccttttatatatttttatatttgcagtaaccatttttccagaagtatttatctatctttcaggttttttaattgaccttcattatgaacattctaatatttctgctattatttcaggagagttgaataactaggaattgtagttcctacagtctatgatttttaaaaatagagatggtaatatagaatataattttattctcgtaatatgattttttatgccccgtgcataagtatatcttgtttatattttgcattcctaatccttcatattgatttagccaacatttctcttaggaaactaagtatattaattgatttacatgttaattaagtaattttcactaggtgtacttactgtgaaaatgtaaaatttatttgctgtgaagctttcccaatagcctaagtgtatacaagaaatgtagtagggagcagtttgagaatttggaaagcctttaatggaggctgtcagacttccttttgccctgcaatttcacattatatgtgttctccatggtgctatgacatatgccacaaatcttgggctagattcgaagatgaagaattatatcatgtaaatcatcagtttgatagaagagttatactcgaagcacatcttaattatctttatattataattatatgaataagataagatttggatattggctatatttacatagatataaatggggatactatattgatttatacattttggtgagaagaatatgtatttctgttaaagttaccaaaaggtgtctgggtatgtcagggtgaggcattaaccatctagcagggatacaggtacacccaagtagttataaatgtatatattaagtatataagtatgtattaagtacagtaataaaaatatttttaaaaaactgtagaaggtggaggaaaggatgtagggggcaaagcctgggatgcaaaggcttccaggagagagggcacttctgttgtgccctattaaaatgcatggtaagtactgttaaagcgttgaggacaggagtgatgaggaagtggggagttagcttttggtgggagataggagaatgattatcagaagatggtgcatgattgggactttggaggatgggtagaattctgaaagacatcagtggagtaaaggatatccgggtagtcaagtagcaggagcaaagccaaaaatgtgagaacatgctgaacatttctgtaatactcctgtttggctgtgaagtatgtaagagggagataatgctggaaaaataggtagagactggattgaggggagcctaaaatgttaaactgagctgctggactcccatttgtaggaagtttttcagcagcagtgcgtaggatggcttagaaggtagagagattggaagcacagccatgtgctgtgtgtcaggaggcagtaattggattctaacagtgaggggcagatttaataaagccctgaatagggcagacagtgacagaagtaatgggaaggtgggaacagatgcaagaggcattgtggatgaggaattgacaagacttggcaatgcctcacatagggaggcggacaggggaggatttcaggatgagctgaggttttgagcccatgcgatgtggaggagggtggcactggcaactgagatagctatcactgagtaggaacaggactgtgaattgaattaaggtggtgaaaggacatagaggttgacattttcagcagtcactaggaattaagaggctagagtataggagaactcagctactgagtccaccacactgctggatagtgctgccatgataggaaattaatattttcaggaacaaatgattaaagttttgaaaatgtggcaaggccgtcatcatcaatgcaatgcacacaaaaaaactggatgtgactaatcggatgtcagtcaaatcacttaatctttcaacagcttaattttcttagctataaaataggaaaaacagaaccagttttgtatccatctcctaaattccaggattatattaaagctattgctttggtaaaaagtatgtaatatgcagctacatatatatatatatatacacacacacacacacacacacaaatatatatactatatatacacatatatattagtttattatattgagagaactccagaaagaaaaaaaatacagttaatgttttactttctttaattgtacattgtaagatattgcagatacaaaaatttttaaaaagaattaatttttattgggctcttactctgtgataggcacaattctatgtactgttcaaatgttaatttagtcttttaattaacaccaagacattgtattattttcattttacaggtgaggaaaccaaggctcagagaaattaaatgacatttataaagctaggatttgaacgcaggcacacagactccagagccaaggcacctaaacgttagttcatgttgcctcacactgagtaaacatctgctcctgagcaggctttattttgtcattgcatttgtattagtgtggccttccctggtactctcttatttctaaaactcttgcagcccaggtatactgtctttgctttaatgcacattgcatttctttgctctgaaggtaaattggttgagggcttgtctcatgtattatatagaaaattccatggcatagagagagagcacaggctttgcatttagtccaaatgcttgctttaaatggaagcctctgtcttgttgactatgagaccttggggaagtgtcttaccaccctgaatcccggttctcatctgtaaacactgagttatagagagttaaatcacataatatatatatataaagcctacagcatctggctcctaaaagtcaagcaccagggctgacttatcccttcagcacagtaggcacagtgttgagcagtggtccccaaccttctggcacccgggaccggttttgtggaagacaattttttccatggtgtttgggagtgggagatgttttctggatgatcatcaggcattagattctcataaggagcatgcaacctagatccctcacatgtgcagttcacaatagggttagtgctcctatgaaaatctaatgccaccggggatatgacaggaggcggtgctcaggtggtaaggcttactggccattcaccttctgctgtggggctgggttcctaaccagggtactggggttggggacccctggtatagataagccacaatacttttaggaacccaaaaaatgttttagtccaaaacagtattttttttttaatatcagaagggaaaaaacaaactttcaggttaaataaattgttgaatatatgatactattatattcatgttcatgccaatacaattgtaaaatataattttcttatttcttttttaatggaggaaggggcccacagtggcaaaaagtacctcagggccgtgaaagtcataacttagcactggaaatcactccttacttaggttctttaaacctcttctggtgtctaggtcataatgttttcttcatgcattttgttgattcattagccaactaatttctagcttatgtcaattaaaataaaactgacctttgttccctcatacaataagatttttctaacacccccttcctaaatagttaatttccttttctgggttacttctgtaccatatgattaagcatctcgcaccatatataaactatttatttgcacgtctatttctcctccttgacgctcaaagcttcttgagaacatggatcatgtcgtagtgatgcaggacttctgctccttacttcagctaaatctgatttcctgtctcacgaccaggaaaaattaggcatgtggacacattgaagggtgaggagggcagaatttattgagtgaaaggaaagctctcagcaaagagaggggttctgtaaagcaggtctgcccctcacaatgaagtaccagcacatgaaccgaagaggccaggctcctcccttgcatgaggcacaaattcctggtggctgcaccctatcctgaggtactgtttgcacatgcaggcccttagtctgagccacattgatttatttcccttactgcgcatgtgttaagggatggactttttcaccgtgggcatgtttagtcaaaccctctgtgcacaatgacccggtgggtcggaacctctggggactcttccctatctgcctaggtatttggccgtctccttgcctctatcagtagccactgctatgtcctcagtaactggcagaatacatgacatttagaaagtcagtcatgaaagttaggtgaattaaattgattctgtttggaacactgacattttattgccagccataggctaattcgtgtttgtaaatgtgctctgtaactaagatttcacctaaaactttatgtatctgaagtgaaaagttgtcatctatcctgcaatattatctcctctttataagttttctatactgttcagcattcttccctaccagcccaattatttcttaaaaattgaaaagttaaataaattagtttgtcaagacatcttccccttcttgctgaattaatttaattaacaaagggcctgtcaaaatagccaaggcctttgatgtctgcatgtatggattccagtattataaatgattctgtgtccctctgacctaatgggaatacagtgtaagggtaagaaatgagccttaattcctcagtaccaaagagagaccagcattacccaattacatctaggagacaacaaatatcaccactaggatttaagtatctagctttatggatggagcagaacacataataaattattaggaaattggttgctgattagtttgcaccatatagttggtttttttaagagactgtaaagtgttactttgtttttcatttatttttatctctcccattctctgatttataactttctcaggcttgaagagtttttacatcttaatagcttgttatatacagaaaagtgaagcactagagtggggaggaactgtgtgcagtttggacaattgtggatgatggtaccaattacatcacagaagttggaggaaagagtaatttttgttcttactcaagtctggtagtgcacaatagcctgtaacagggctggctactggtagagattatttttcattcttaatatctctgaaaaaaagaagtggctggatttagcagaggaaaatcagtgtatgctcatgtatagagattgaaagttcacaattttggcatggtctaatacttggaatttcatttttattaaataggttcttctaaagttgttcaaattcttaattataaaggaaggatggttggtaagaaaaatgggtaatgattaacttgatgtgaagttttaggggatgattttctcactttagtaataacaatgacagtacctattatagacatgacatttttcaatgttttcacaggcattatttcttttgatgctctaacaggagagttttattgtcatcaatatttcacagatgaggaaattgagctacatggactttaagtgatttagacaagatcttatacttagtctggcagtattaggaccaatctgggtattattcttatttaaaatctcatattattcatgccttccttgcttctaagctctttagttcagtaagatctaatcacaggccggcctcctgctacaattggaaggcaattcaaaacaagctttctctgaccctttccaatctcgcttccctcagattcctcattcaccttcattggccacttggaccttaatcgatgcttttgctccctctgacttgggtgttacatgtggtctgtcccttatttgggtttggtctgaaaacatatttgtcttattttgtcgaattaactactcaattatataccagaacagcaggaagtttagtttctctttcctaaggtttttcctcttctccttaattattcaagaatcctgaagtttgctaaatccaaaggaaccattctgccttctaactgccaagcagagagcaaatttcacttgagccattggctcctactattgcttccaactgtcacacagtgttgctatggtatatttatcttgcacactaccatagctaatatttattcactattgatttttttgctcttgtgggtataggtcccttattatcttacaggcatactccacattgagtgccatgattacaagtctttcaattcacatttccaggtccaatcattatttcccaaactaggatagcattgtggcaggtggctgcgtttagaagggctttctgcataagcctcaggctggaatcatctctcatcctcaaaaacatccgtgtgtctaaacccaagattccagttggtattctccctttccttaaggcattttatttcagtattttattgctctttcctccaacagggatttggaagaggtcatctttatccatcttgataggtctcccaaagtttaaattttagggagcaagaccagagtccttcttccaggaggatcagggaactcagcaaatggcatctttggttgtcttccaaattctttttctcgcttcttcaaggaagaagatcccctcatacttcatattcacatgactaagaagataccttcaaggggccaggaaaataaatgtctttatgtatggaaaggctggtacaattttaaaataaattcccattgggcattctacttaatctctttgaacatgcctacatcacacttatgtttgcataatgctctatacagtttgcacttgtatatttgactcttacaaaatgcagtgaagtagctataacactttaatctcttcaattctaggtagaaagattaaaacctatgaagttagacttgttccagatagctagtaaagggatatattagtttcctggtgctgttgtaacaaagtaccacaaactaggtggcatcaacgacagaaatgtattgtttcaccgctttggaggagtctgaaaccaaggtgttggcaggtttggttccttctgagaactgtgagggagaatctgttccatgctggtccccttgctcctggtagcctgaggagttcctttggctcgtagatggtgttctccctatactgtaacatagtcttccctctatacctgctcaggtgtccaaatgcccctttttataaggacatcagtcatattggattaggacccattctaatgacctcattttaacatgatcattggcaaagacattatttccgaataaggtcccactcgtaggtgctgatggttaggacttcagtgtcttttatgggcaacaaagttcaacccacactataagttaggttttctaaccctaactgtcacaagattttcactatatactggagtctcttgtaatctaaaattttttcaatcactgttaaagcatttgttaggaatacacttaattgttattgatttaatggctcctgattcttttacaggatttttttgttgtttttaaaatttctttttaaagaattctcaactgaatcttgacttattgttttatgataatcaattttctaagagttacttctcaaaatccttgagatacattaaaaaaaatggttaggcttttaaagaaaagccaatagagatgtaacacctgttaggaaatgcagattataattgtaatgtaaatgtaattatacgtgtaaaattttttgtgtctagtaatattacccagggataatagaatgaaaaatttattcactgttgcttggttgctcttgtgtatataaatcccctttcagctcacagggataccctatgtgtaaagaattttaaagttgtaaaatagaatgggcgcttgttactatttataagcatggcatggaataatactgagatgtttcctacatttgaaaaaaatgaatttaactgtcattatcttttctatatccatttaatattcattagtacagtagtttgaaaagtgggctttagagtaagaaaaacaaatgtggctgcatctcaactgtgctgttattgtatgagtgacctttagcaagtagtttaacttccaagttttagggttttttaatgtctaaaattgagataagaagaccattttcctcataggatttttgggaatattgtctaagaaatatatgcagcatgcctataacaattccaggtactttgtgagcagatgatatacatcaacaatattgtcaccaccagttaaattaattagttccattgaaattgtgattactattttaccctattaaattaaaaccctgagcctgaaaagcaggagttgctgggattctgtgcttacagcaatattagaaacatagttggcaataaattattattgttttatgtcagagattggaactatgagtcttatgggcctactgttttcaatacgtttttctgtaccaataataactttaattgttagaacctatccagaaactcctaagattaaaatttttttgtgtgtgtgatttggctattgatttttgcttttcttttttagcaccagatatcctttcttgtttgtcccaaggcttttcattatttgttagagtgacttcatttcatggtattatctacttttattttcaagtgccaatttattaacttaaaaatgcataaaaataaacttttgttgtgtaagtaacacatttgcatgtgggaagaaatggatgagtgcacacacacacaattcaaggcacccatagtcctacaatgcacacaaacacatgtgattcaaggcacagatagtcttacacctcacatagcatcagtgtttgcattttgagataccatatcttaatgtcatcttttgacttttacgccatgttttggtaaactgaatttcgtctggattgaaactctcttctgcatagctaacccctttggtttcaacaatgtgcagagaagagaactcagcagcaagcagagtcaataggggttctaacatctctcttccagccctgggttcctttcatgtaaaggtggcatccaataggactgctgaagtagcatgaattcacaaatggaaattgatttctatcaattctatatgagctagattatcttcataaaatccaaacagtctgattctaaaacacaattggccctaaagatgttgaatgagagttgggaacttgtattagcatagggaggtagccaaggaacagtgttataaggagaagagccccagaaaggcagttatgtctcaactgcactgtgattttatgaactctaattctgttctggactcacactgctcaataacgaggatgcaaagcacctgcagcctcctcctctttattctgtccatttctcaccatgtcttgcagaccaaggcatgtttcctgaattcctagacttaatgctttctgttccattaacgatacttaatacattgccttcttcaaataaaacagatttcctttgttataacgctacatgacggtcaggctagaatgatcctttgctggagccactttatgaatcatacctgtttgtgagattgtaacacaataaattccatgccatcgttttgtctctgaattgagaagaatcccaagaagggcaaatgtcacacttaaatgctatggaaagagaagaaaaggaaggactggagaagaaaacaaaataaaggaggagattcatttttccatagtggatagctacttgaattatttttaattattgtggttaaatctaccaggaaaaggccaggtgtggtggctcacacctgtaatcccagcactttgggaggccgaggtgggtggatcacctgaggtcaggagttcgacatcagcctggccaatatggtgaaacctcgtctctactaaaaatacaaaaaaaattagctgggtatagtggcaggcacctctaatcctagctacttgggaggctgaggcaggagaatcacttgaacctggagcacggaggttgtagtgagctgacattgcgccattgcactccaacctgggcaacaagaatggaactccgtctcaaaaaataaataaataaataaagttaacaggaaaacatttagtaattgtgtattctgtttccccctacaactactgtgagtaatctgcacttttatttctcttttggcccataagttttacattaatcctattttgctatttactgaataaagggaattgagaaaaaggcatttctcattccaagttagccctacaatgccaagtgtaaaaactcaggcctaagtgaagtttgaggtcaggataagccaggctaacagatctttctggattttactttgcatctcattcattcattcatttattcatttaactgatacttattgattactgaggatgtgccaggactgtactgggtgctgcaatagtagtggatgaaacagtaaggtccctattctcatggagtttgactagtgggaggatgaggggagagcgacaagtgtcagtatacagtaaatcagtgaacgagtatttggattatataactttaaacagtgaatggggctgtaggaaaaattgaatgggtaattgggtagagggactggaggataggtaggtaccgttttagatagaatgatcagggaaaatttctctaaggaggtaggattagagctgagaaagagacagatctaagggatgtattccaaaaacagggatagaaaatactactaccctcagataagaataagttaattctgtccaatggcagtgagggggccagtgtgtaaggtacagagaattgaaggacaggggaacttggtgaggtttgggggtttggtggggtctatgtgccacagaaagctgattttgtttttgtcacaatgggaagccattagaggctttgaagcacatgaatcaacatattcttatttataaaggccattctgggaaaaacagtgaaagaaggaaaataaattaagagactttccaagaagtgagagacattggtggtttgagttgtaacattagaaacagagagcgtcataacattagaaacagagagaagttagaggattcaaaatacaaaattgagctgctagtagttgctgttgtattgatgttgggatgaggaaagagatgaatccaggatagtttccggttttgggatctgaacaaatgggaaggttatgctgccacttactgaggaggggaagacttattagcagactagccagtttgatgtgtgtttgggggtactgtggggaagtacttaaaggtcacttctttccccttttgtgtccttagtgctttgtggtgactcaggaagttagagtgtgtacttttttcaggtgatctttcatgagctgcctactctgaacttcattggctttgatttccattgcaacctaatttttgaaataccaaataggagtatcattcttctccctgcaaaaatacttatgtgtatgaagattacacaaatggccagttctcagtaaatcatgtgttcaaagttgtggttccatatagtgatgggtttatgtggaaacagacatcctcatcttgcttcatctgctgtgtaatcattaactcatgaagataacaggactgtctggggtcatgggctgtgggacagaatgaagctccattttctacaatggagagaaaatcccaagaatcagtattttcatacacgaaattaaccagcaaaaatcttcaagaacttaatccctttccagtgaatgagtaataaattttttgttcttcttttttcgtattttgtagtcaaaagctcatgtataccgcagggttttacaacactttctgtctttaaatttaaagcagcaataagcagacatgttctgtaaccagatccaaatgttctggtccctgctttaagttgagaaaatctgatttggcaaacaaataaatgagcaacaagaacagcaaaactaacttgacaaaatgggtcatttagtttggaaaggggtttattgtagaatgcctttaaataataaacaacattaaaagacttaaactataatttcataaacaattttacagagacacatttatttcatctaacattgaccttctgtaatgtgttgaatctaaattcttaagttaaagcataaagtagcatggggatttttacttcattttcaaagaaaacacaatataatctttcatttcattttcctcaatgaataaaatatttgtcactctgtgttataatgtgagcgcttctagtaatttttcatttttacctgaggtttcttttttacccactgctaagttcatttctcaggtcagcaataatgttgggataaattcataaatagttattctttgaatggtgaaaataaaatgtgttttattcatgagtaagtatagtgtttgcttgttgctgatattgtatttgggttgaaatacatattttctttttactattatctattttaaataattctggaaatacagtatgacagattttaatcagtaaagcctagcattgtatgagggtttttttctcttttcaagatagtgtatgtgaaagcatacatcaataataataaaagttgaattcagatgaaaatgctttgaaaatggtcaacatatgcaaatgtaaggtatttttattattgttattgttattctttgtcattattaaggtatactcgataatgatgttagcttggtttataattcaagcattaggtaataaagacaaggtacagttaattctgcattggagactcatattaacaaacgtttttggtaagtctattttagtcatttcatagagggctttgctggaattgtattgcttcaaatacttgttttcagtacttttacattcttggaatacttgcatttagatttttgttaagaggcagtatatggtatggtggttaagaatgtggtctatacctatggtgtcaaactacctgcattcaaatatcacccaagccacttattatctgcaagagcttggacaagtcatatagccattttatacctgtgtttccttatctgtgaaatgacaataataatagcattcagttttgatgatcaaatgtgctagtttcccagatgtgaaacattagaagaatacctggtgtatagtaaaaaataaatgtcagcaatgattatttcttacacaagcctggtgaaaattcaagtttactggttattaaattgcattggttctgtttggggtcttcctcattatgttcagagatcagcaatgccctgaggttttttttttttttttttttggcggggggtcatatttgcctgattatatctcatcgtcaagtagaaacactaaaatacataattcaaaacaaagatttgatcttcaaaagggaaagacaaagcaccatctcaaatttgctgtaccgaagggcctggctcagtgcctgacacatggtaggtgctctgcagacctgggtccacccatggattatctctgcccaggattctgacccataaaaggaagggcattctttccacattcttggtaaatctgtgtaggattcttatcttaaatgtagtctttaaccttaggagactcagaaactttgaaactatagtattatgactgaaatattaagctttttaaaaacacatactttagttcatttagctgtctaatattttctctgttcttaaatttgcaaccttttaaaatgtatggttttaaattacatagtggattattcaggtactcatctaacatttaaaatgtaaacagtgcaaatttttcttaaaggcaagaagcaggggattatcatatgtgaaagggagtagaaatatgatctttttattcttgcttgcctagattttgcagttttaatcaaattggcatttaaaaatactgggctctatctgttaagaactgtctgttgtttatagagatttttaggtgtaaattatctagccagatgtttaagcaccaaagggaaacaagttaaatacaattaacccagtcttcatttatcaagtagttaattctcagcggtaggccacaaaatcagtcttttgatcccaataatatatataggtataactatttagataacataaaatgaaagttacaaagccttattttgaaactctttaagcttggccaaattagggaacattttattcaatataggtggcttcccaaattttggttactgattgcctttgtcattgcctttaggacaactgtagactttgtggatattggaacagatataataattgtactgtaatttcccaccaggtaaatcacataattattatgggagtatgaaaatatctgagaacagggacagggtgggggtgtgtgggatacatacacatatgcatgcagtataaaaataagattgcaaaatgttgcatcatttcagttgctcaactgcagctcaactcaactcttgcatagtcccctataacattgtgttagtgtggaatttaggtacattttaatatgtttcatatgctatgaggtcggacctccctaaaacaatagtcttaggatctataaagttcttaaaactcatctgattatggtgagtttttaaacattttgcataattttttaaattctaaaagtattatgaaatgacagaaggtttgggtttgggaaacaaagggaggaaaaaaatcagctactacttaacaaaaatcatttgtaccttgctctatatctaaatctatatctacatcccattgtactttcaggcttgtactttatttcttctatgcacctacagtgaagttttaaatattctgggctctgtgtataaaggttctgagttcttcagtattcctgagaaggagcttaaaaatactgtgatttttataagtcgcattagagacctaggaaatcattccaaaacattaattttgagccaaatttctaatagggtattaaaaacaggggtatagtggaaattgtattaaataagaatcaggagtttatgttcaagtcgcacttctgacaacatgagttctatcagttgaagtatgtttgcgatacatgaatgtatatgagaaatacacatatacagtcaagagaataagcaatgattcatacgcattccccagaaccatgctttatgcttaaacaagatttatggacttgttttcttgggcttgcatttccctgtgagagagtattttacggtgggctggaaggtgtttctgtttctcttggttaacatatatggggagcaacagaaggtaacaggaatgattgagagggagacaaagagaccttgggaagggtggatgagagcagtggggaggaagaaagaagggtaaggatccaattatttacttgacatctatttgcaactctattaagtatggagataaaaagagagatgggtattaaggggacaaaacacagtggagattttagctacccccagtgttttcctctggctcactgacttccagttatcctctttctttgcttattgttacatgtttttggatatcaaagagagtatcctaaaataactttgatacagttaatgatcttagtggaatgataggagttttaaaaaagaacaaagagcattccatttgtattatagaacaattaaataaaaatccacttacagccataagttgcaaatttttaaacatatatcatttacttatctagctcatttttacctcatctgcctatgtaaacccatcgttattctaagtctcccttaataaactaagatttccttcttactctaatatttgagatctaagtacaatccaaatgtcagaggttattgttgttgttattatttccaccatggagacctccgattttctaataaaatatttttataaattttactcaacacaaattagtttacttttcatgctgtctccaaaagtgaggaagtagagtagttaagagtcataaattcggagcctgagttttggggtttgatgtaactccacacctaactaactgtgtgaccttgagcaaattacttcaaccttctgccctttcatttcttggtctataaaatgatgacaattatagtaattttctcataatgctgttatgaggcttaaattagttaacttggggtaagtgcttaaaacagtacttagaacacatagctcttcatatttcagtggttctccacgttggtgacacattagaatcacctggggagttggtgctcacctcacccattaaatcagaatctttgggggtggggcccagtactgggagcaattgaaattgggagcaattattgaaattgctgaggtgattccagtgagcagccagcgttgggaacgatggccgtaaatggctgtaattatcctgctgactaaattataaacttcctgagggcagggagtccattacttctttttatacatccttcctagtgcagctagcacagtgccttacttgtaactaatgctcattaaatactatcaatgaaagaaaacatgttgatgatattttagatgtgtaaagaccttgcaggaccacagaggtgctaattttaagcattaattattcattccctcatttattcatttatatgtgctacacactttggagtcttgatgctaaacactgcaggcatatatgatttgaaaatgcaatccctgttccaaagagtttataatttagtatgaataaatgcatacatgactttaatagaagggaaactaaccatgtataagtgctgtgttacaatttaggttcccttggaggctgtctctaagatggagcatgcagagcgtttgtttggaagtgctcttgagaataacacctctgcgtgtgctggggaaagggaaagctatggaaccattgaaatatgaaataattggacagggaaagaagttaggttttgatgcattccaagtgaagttttcagctaaccccacaggagctctggggctggggtgactcttcagagtcttaagttgggctgcagggggccaggtttttattcctgcatattgatcagtgcttggatacagctgtcactggaagtagtgaccttggatgaggcatgtttctttagcagaagcaattcccagatacaagtgacagctcagggtgccctctggcagttcttccccggataggggaataagtccttcattcctaaaggaggattcgagtggagtgtcaccgcgtccatcacatgcaacaagagataaacgaacaaaaaaaattatcctggctaaaagaagagagatcacatttatttagatggggaggataagagttagggtgaattgggaattactttttcaaatggatgccattacaatttgatatttaaggatgggtgagatttcaagaggctgaaatgaggtgcaaggtgttcctggtataggaaacaatagaggtaatggtggggaggtatgaagtatagatttgtggagaagcccatgggtctagaagctcaggctaagcagcttaggcataatttggttgactttcaggagcagggaagaatatgtgccagtgtgtattagaaagattagcctggtagcaatatggagacataggtggggcagagcttgcaatcaggaagattaggtaacaagccaatgaaataaactacactaaggatcaatgcaagaagaaaatgcatgagaaaggcaggaaagcagagaactgcaaagagctgagtggatgcaggaggcagtgtagatgtacgtgggacaggtatgacagcagacaaaatgtttctatgtatgtaaggtggtgtgagtggtcagtcaccaggggatagcctagtgaagagaggcacagtgatagagaagagagccagaaagagcagtggctttgatccattatccgcaaaggaagagacaagtgtgaccaaggtttttatagagcattgagtgtgcatgaaggtagattactcatgttgatttgaatcctgttttcttgtattactatctgggactttcttggcaatgtcagaacattctgtcatggccatataaacagcacgtatgtggtctgagcccagtcatgttggagcactgtgctagatggtactaggcaaagctatgaaatgactaatatttgttctaaaaatgctagtcatcagtgttttcactttctagccatcccttccaggcctttagagtactcatccaccttctatcttccttcttccctgtcaaaaatggtcgcttataccacagtgatggtttctccaattatatgtcatctattcctgaagtatctgtagtcataggattcaattcaaattctctttaaatgaattttggtgaataatattattttgagcaagtgggcttctgagcccctggaaatgatgttaagtgtaaggccaccctcggtgatttaattttgagggccagtattttcaggatttgaacaaagtggaaaattaagtgatttttgcggcttcttaaccttggaaggaggtcctggaatgatataaatactgccttctaggggactcagctgtgggacattgtatgacttaatattgttttaatttcttttttctcctctctgtcacaaaaatgagatggatgaactgatcatcccataatttttcattatgaaagaacttttcctacttcatcttaatgtctagggtatttcatttaagaacagcttaaatgagccctctttcaaaataagctgtcctgtaataccattagttcccagctagtcactttgtgaagtcacagaactgtgtacaatctctcttttgattctaaaaccttgggagaaagtaattgaagtatagacacttgagagtctcaattttattgctttgcaaagaaatttcaatttagagtttatctaggttacagtccccaaatatttctcaaggaggataaatcaaatttgttggagagttcctagtcatgtatcattcagtcctattacctgaactgccttgtttgacattgtcagttggaacactctcttggctatgattagaactcaaccttggtttgggtgacaactcactcttcttgcttgtttctctctttctcgcttttaactccgagattcaacatagttctttgaaatgatttatgtttcatcctaagtcattagtgtgtgcttccaagtggccaatctttcctcctttgttggttaatgtttataggaaacctcttggagtaatgactcactgtgatacttcatcacttgcctgcctccttatatttgagactttacccttctttgcatctttaaaacatattctgctctctcagtggtgaatatgattctatgcctgctctatgggtaaacacaaaccattctctatgtattaggaaagataaatgtgtgccactctcctctgtttttctgcaagaaatgttcttttatctgcagactaagaaaccatatacaaaactcatctaggttgcttcacagatgattattcatcattagagtattagaaatcaaatgaaaggataatatgtaactacttttaagaagtagttctccttttaaaataactagctcactcaagtacttctattttttaatgctactttccttactcagtaagagtcaagacactatgagactctgcgaaatttgaattctgcttgttaccgaaaccctgagcccttatagatgatgttagagagcaccttttccaaattccttcaggcgaagcctcgcaatcatgaaagaggggagaggaatgctttggtggttatttgtgcaggtgataatttgtacagaactagacttcagagtcttggagctgaagggagtcacaaaggaaggtttcttcaatctctcttcttttgcggaaagaaggatgtcatcctgactaaagtcataaagcaactagcaacctgagtaattgaatgatttaaccaaagctcactttaatgggtctgcggtccacacctgccctccaatccctatgaatttttttttcatcaatgtatcccaagcagctaaaataatgcctggcacttagaaggccctatttgctcatttactgaatggatgaattgatgagctgagctaagggaaaaaggaattcaaaatagcagttgctttcctcttaggcagtgttttttccaccacctagctataccttatcttgtttgtgtgttttgagaggcagcatagtagaatgctcaaatacagatgttttggaaaagaactgcctatgttcaaatttctgcagtgtaatcttcaacaaattacttacctctcaattttcctgtgttagagataattatagaacaatgtctcttaggattgctgtgaggattacccgagttaacttgggaaaagtacttaaaatgatacctagtatattgttggcactcaatctgtgttagctgctatctcgggaatgggcagtcagtggcatgtggtgtaacgcacagggttcctccctggaggcaagtctggaacttgacaagctcctctgaaacaaggtggaatcatggggtttcagcgtggggtgctgaagacttgcactatgcagctctcctcacatgccacattgagtcccagatttctgcaaccacagaagtttaagagaagctttgctgaaagtttgaaaccagtgtgaatacattcatatggtaaataacagagcctctgaaaaggagacaatgagatgcccaagaaattctatgggctttagtgccacccaaatagaatgtctttattggctcagctgctcattagctgcctgtcctggcaaaactattcaaatccttagaaccttagttttcttacttgtaaatttaattaaaaaatacttcttgtataaaatatgaaataacaggtacatgtaaagtgctaagtgtatcatagagatgtaataaatgataagcccttaaaataacgatcatagccataaaaatccaagggattggaaaaagcaatgcacatactatgtaaagatatcattatttcatttgcttgcttcttcagaaagtaacaaggtggtttctaggcagtcagtgccatgcaagtattttgtctcaggagcctttgttcttgaaatttttatccatgaactctgttaaaattataccatgacttcaaagtcatctctgattccaaagcctccctctaactaggctgcttgcaggagactttggtgtctttcttcagtagaagaagaaagaaagagagaggaagaaaaggaaggaagggagggagtgagggagggaaggaaggaaggaggggggaggaaggaaggaggaaaggagggaaggaaggaagggagggagggaggaagggaagggaggggaggaaggaaggaggaaaggaaggaaggagggaggggaggaaggaaggaggaaaggagggaaggagggagggaaggaaggaaggaaagaagggagggagggaggggaagggagggaaaagaaaaaaaggagtatagagataactaggcataatggacatcaaggccaattttgtcacccatttgtattccctatttttccctttcttttggagcttattgataatgaggtgtttcatctgacttttgtgagtgaaatatggctgttatcaatccatactaccttgtaagatgactggccagcttagtctgcaataacaaacaactgcagaatctcagcgcttaaatcaacaacaaaaggttatttcttgttcgtgctatgattccactattgattagatgggagctctgtgctgcttcatgcttattcagccaatagagcctccactgtctgaaatgttgctagtggccatcatgggtgagggaagatagcaaattatgatctggcttttaacacatatctttgtctaaaagactatgtggccctgacatttgtcactttgagacaggaagtaggctggaagaggaatgtgtcaaatatttggtgaccagaaagttgagtagtcattatttgggattcccgtctattctggttctcttcttctgcatacatggtagggttgcactttgatgcccatttgaattagccattggccagtgaagtgtgcataaggatgatgtgccacttccatgttgaagcttcaaaatctagcgtgcagtttggaatattctttcctcctgtccaagtgacccatatgtttatggctctgtcagtctgggtttttgaatgaagacaaggtggagtagattgctcccaccaacctaagatggatgcgtactatgagcaagaaataatagatttgtgttctgtcattgagatttgaatgttgtttggtctggaacatatcctagcttattctaaccaattctgatagggaacatattaggataaatttccaaaagttaaaaaaaaagttttcttttgtttatctagatatatatctcctcaaatttaatgagcccagaggcaatttttcagtatcatagggagaaaaaaattacgtaggctcctttgattggttcacttgattagtggtaggggtgctggtgttagtaagaggtcatatttgggaacaaggagctgtctatattaattatagctgcaggatgtggttgggctgtcaacttcttttctgctagacagaaaacataatttagggatccatcacaaatacatttatcctaatgacaggatatcggagagcacatgattttcatacacactgtctttcctttctactttttctttaatttaaatgagtttattatatacttagatattttaaagggaagattcttaatttcttagctttgttttatagaaatcaatgaagaaaggagggtattattggcaagtgggaaaacaataggtttgtattccaagcagatggtttgtggacctcaaagatttcacattctctatcagtcctgaaaattagacagagttatgaaatcaagtacagagcgtactactgattcgctgtgtgaccttgggcaaggcacttaatcactttagatcttagtttcctcattttaaaaatgaggataataatactggcataagtcacagggatgttgtgtggataaactaattaatgattgtaaaatgctttgaaagtgcaaagcgttgtataattgttaggtgctattattaagaagtattattactgtgttgtgtgtaattcttattagggcttctctttgctttgaagtcagcctccacgtggactatggggttgggataagtttacagatgtgctgctcaagtgccttttttgcctggagaaaatactcagtagctagggtaatcatcattatgaagaggatctcttcaagataaaaaagataggaaatgatctcctttttaaaaaatggaaattgctctaactttaaaagtatcaatcaattctttaaaacctcatacagccctatgtttcaggaaagtctaacatcatgcaaaatttgaaacttcaggaattttctgctcagcataacatgggaaatgttgttgctaagataactttaaatcagctgaaccagctctttctaattttcccacagtgtttgcttcaaggatgaaaacaagtgaggtatcctctagaggagagaaattctgagctgtggctgtgttttgcatgtacaaaaagttaaaaccccaatccaaattaatttttatttgttttgtagattctccgttgggaagtgtgtttctaggtacataaaaacgagctatttttctgaaggtcaagtatacaccatgtttatacgtgactacctggtgcagctgagcaatattgactttgatgcaaaaagaccacagtcaggccttgggaggatttctcattagctgtgtgagttttaacaaaataatttaacatttgcctcagtttccatatataggaatgtgtgtaaaataattcctgcttacctaataggctctggaagagctcaaagaaggtaaaatctttggaaaatattttacaaatacaatgaaataattaaattgtattacattattttatttaacattttaatcatttttaatgtattcctgagttaacaagcctctacatatatttccattggataataaagatattagaaactcaaataattttcttgcaatgatctacatacatgcctttagttttatatcccatgacatgaagagaaagaagtccatatgcactttctgagaagttgtccgttaagtaggtcaaggggtatctgagatgtgagcgggtagctttggtcatttgcttttctatgattgcacacctttttaaaaaaaaatgctgtgtgcagtcatatatgtgtacagcattaccttttaaaatcaccaggaactaggaacataggatagatttgtttgctatgcaaatgaataaaacttgtaccaaagaaatctaatgtttaactccaagacacaaaagagttgttagagtttgagcttattgtactatcataggggataaaaacttccagaaacttctgagaggccagaagttttcagagtctagctttctaggatctgaggacgaaagtacttaggtctacccttgaggcaccattattttctaccaaacatttcacttcttgtgatcgcctaagtctttgcaagaagaacaaatctcacaatccatttatttactctcctaaaaatgttgaccacgtgaaatgacaatcagtataccacagttgtttatcccctcagtggtgccagagaagaggtaatggcagagtttgtaaggtttgctttctaatttttgtcttactggcatattttctatggtagatgctctggtgggtacccagatccccctttcagaaccgaggcactatttccccacctactggaagtgttgtctgctgatgactcacggctaagtccctctactggacttgactgctggtgcaggaagctgccctctccaaggtaatgcctgcctcccaggggctagctcacatccagtgactcaacaacatagatagtacaaagccacagccccttgttttgatgaggaaactcccaaagactatcttaatgccaaagttctctgtaagtttggctgagacctgtgttacaactgaattacagttttttttgttttttttttctcaaccaaccttgaagccatcaggctgatatctagggtcaattcccaacataacatggacaagaatatactgggtctgctatggaaggaagctcaaagagccatgtgttctccaggaattgggagcatatatgttggactggatccagagggtgctggttcaaagtggttggaacagaaagttgaataagggagagtttatgaacgtgggatcacttgctaatgatagagaatttaacaccctggcaagggctttgggagatggtgttaacatattgctaaaatgattcttgaaagcttggtaaaaatgatgaccaatactataataaatagaaatgccagaattttgctgtagcagacagtggatgaactaatcaaaaggctcagagaagttgtgttggtacacagagggctgaaaaactaacagatggtcgtgttctggaggacctggagccaaacagataataaaaatattagtgagaggagcatcatcatccctgaaaagccagtggtagccatcctctgttgtccaaggttcactgaaaagatgctgttacagaattggactctctgatagcaaagaaaatggtgatgagcataagtctggcccctacaaaaaacatataaattctagtgaatgacagagggctatcacaaactcaaccaggcttcaagtacatggttggcagccattgatctggcaaatccatttcttctcatcttatcagggaggaggaacagaagcacttcacattcacttgaattagataacagtaaaaacttacagtcttgccccagggctatgttgtctgtcttggactcttaaggaacctggactgtctggacatctgctgaatctcacatggatctgttatttgatggcataatgtttatcagacttatctgcagtaagtggcaagtcttggtaaggcatgtgtgatctagaaggcaggaggtagaccttatggggatacaggggtcttctccatcagctttaggtgtctgaggcatgccgggacagcctctccaaagtaaaggagaaactattgcaattaagcagtgagacacgttaagaaggaaacacaacatctgacaagcctctttgggttctggaggtagcatacatatttcacacttagtaatactgttccagtcttttactaagggacattttaatgctgtcaactttgattgggttttagaatagaaaagagctggatagcaagttcatgccacagtgaaatcagccctgccactagagtcatataatctggcatctcttgtgcaaaccccagtaggaaaatgacaaaacagaaccatagggttaggagcaaagacatgccctctgcagctaataattatgcacctttggaaaaataactttagtgtgtgctactgggtgttggtagtatgaagcactgaaatgaaactactacatctgggattgaacacagcaaaggccagaaggcagaagaaaactgcatgagcaggtggcccctttccacatgtgagggaccacagtggaaactgcacttcttcctctgctcacaccaatagctgcatccaaggtgggggatgttatcctagttgataaagaaggaaaaagtatgagcttggttcatgaatttatcagcttattagatgaatgccagccagaaatgtactgctgcagcactactacctcattcaaaggtgcctctgaattatagcaatgagaggaaatcctcccaaaggtcagaggtttgcacattgcaccttttgtatggtccaagttaagaatatacacaaattcatggttaatggtgaatggcttggccggctggtgagggacctaggagagattgaaagattaggctgggtgtggtggctcatgtctgtaatcccagcactttgggaggctgaggtgggtggatcccctgaggtcaggagtttgagaccagcctgaccaacatgaaaccccgtctctactaaaaagacaataattagctaggcatggtggcaggcgcctgtaatcccagctactcgagaggctcaggcaggagaatcacttgaacccaggaggtagaggttgcagtgagtcgagatcgtgccatttaactctagcctgggtgacaagagcgaaactcagtctcaaaaaaaagaagaaaaaaaagaaagattaggaatgagggggtataggaagtggtatatagatggacctattgaatggtcatgaagtgtgaagatctttgtagtatgtatctgttaatgcctgtcagagggcaatcaccaccgaaaaagctctaaaaataaaatagagaaaatgaccgtagtcattggccactccaatgctgacacaatgattgcatgaatggagtagacatggtgaaaaagacagagtccatgaatgggccatatggcatgtattcccactcaacaatattgacctggccactgctgttgccaaatgcctaatctgacagcagcagagaccaacactgagcctccaatatggcaccatctctttgtgagaggagccagctagttgtcaatgaatatcatcagcccccaggtatgactttgcctttcctaacttctgaagctcagctggcatcactgtttgagggctttagagtttctgggttttttttgttgttgttgtttttcagatggagtctcactctatcgcccaggctggagtgcaatggtgcaatctcagctcattgcaacctccaactcttgggttcaagcggttctcctgcctcaacctgctgagtagctgggattacaggcatgcaccatgatgcccggctaatttttttggtatttttagtagacacagggtttcaccttgttgattaggctggtctcaaacttgtgacctcgtgatctgcccgcctcagcctcccaaagtgctgggattacaggcgtgagccactgtacctgaccaagtttctgttctatcaacattgtgtatatattacattgctttagatcaaggggcacactttacagcaagggtagttgtgggggtgggcacattacattggatgctatcacatatcatacttcctagaagctgtcagcctgagaaacccatggcacggccttttgaaggtgaggtagtagtttggcatggcatctgcaaggaaccagcttggagatgatacctgtggggttggggtgccatctttcagatatagtatatagcctaaaataatgactattttacagtgctgtattcccagtactacaatcaataggtccaggaaccaacagaaaaggaacaggagtgtccctgcttaccacctctcctagtcaccctttagggacattttttgctttccacttttagatatttgggctatgtttacctagaattcctggttctaacacagggaatgctgccacaagaaggcgtggtaagatttccatcaaacttgaagttgcagctgctccctgcttacttcaggttcctcatacccagagaccagcaggcaaggaaaacaataatccatactggcaagggtaacgtatcctcaggaggaagtatggccattgtcgcacaatgggagaaaggaaaaaaatatttttggcacccagctgatccacttaggtctcacttagtaccccctattcaaacggacaagtgtgggcagctgtgacctaagacaggtgtggtgattagggactcagtccccttctagacgagggtctgtgttatataccagcaaacaacctggactggaagagatgctagccaaagataagaagaattggcaagggatagtagaggatggagacaatgaatatcagctgtgaccttgagaccacctgtgttgggagctatagtttgtcccactaactttcctcttgtaaatttctacaggagaagagatagactagaatcctcgaggacctgctcccagagagtgagaatttactaacttactatatgaactaggtggatctgagtggcctgaggagtgaactaaaatgcgtgctgtatgtaccacctcgatatcccctacagaaatgagacatccaatccttcagttgctagtagtgttgcctgatgatgattcaaaactaattctctcaatgggaattggcctcttctcaaagtagctgtctcaccaaggccatggttcctccctggcagtaacctgcatctaatgactgggcgatgtaggagcacagaagcccagccctactgccttgatgagcccattgtgaagggtcatctcaggttcagaggtcccattaggatcaactgaggtctctgttgtaagtgccttgtagttcaccttctccttcagttcaatcccgtttctctcactactttacaggcattgttcctgggaatactcctcaataaacttcctgcataacaaatctctgcctcagagcctgtttggaggggaggaaaacttagaactttgtccccaacatcaaaatacaatttaatttaaaaacatttcagtgaagttaatatgttttctgaattagtgcacccaaaaacatttccaagcaccccctttgtgtgttttgattcttacaatctatgtcctttattcattctatttattgaacaattaaagagtgcttctcatatatgaggcagtgtgccaggcattctggattcaatgacaaaaaatgcactcagaaaattcattctggattcaatgacaaaaaatcctgaccttaaggacctgatggacaaaagggaaaagcagataaattaatagacagttaaaatacactataattaatagaacataatgtgggaatgcagacatgggataactaatttagcttgttgagcagagcaacacagagaaaaatttgtaaggtttcccaaaagcactatctgatctgaacctttaagataagtaggaaataggtaggtaaggaatggaatatgttcagagtgggaagcagtgtgaggtaaaaagagaacaggtttggagaaaagaaaacacttctttaggatcagaccaaggagtgtggcagatattagtgtgaggtgcagagagctgttggcatctgtggagtaacttcaggcaggggagtgatatagtcagcttttcattttggatttattactgtagtctagtggatgtagagagaatggattagagaggagaccagttaggagttccttgcatcaatctagctgagaaacgatggctggaaatcatgtagtagcagaggacatgaaaaaaataaaataatggaatcctgagatttgaaggaatttgaactaataaatgtgggtgatggactggatgtggaaatgtagagtggttgaagataccctgtttggattaggaggtagaaatgctattctctgaaatatgtggtgagggtgaaggtaatggtggtaagtgtgtttgtatgtagggagagtattgcaggaaggctgagatatgatgacttttaattttctatttctatttcagacatttggagatgtcctaagacaattggctatgtggatagggagatctggtttagggaccatatcatacagacagtagaagccatggatgatctcattccaggagcacatatacagtgggaagagaatgaagctgaagacaattccagctccaaagatagtgacaagagctgttcatcttcatcatcctctctgtaggcatcttgaattagaagatactatttagtgtggtctcttacccaagataaataatctaagtttccgtaatctttcctcattgttctaattgtgaatttctttggaactttggtgatgttttctatgttcccatttagttctgagtaccagaattagacacattatatttattattatctttgacaaaaatagtgctaaaaaagccttcctaatatgccatatgcatcacggccgtaggaaaataggcgtaccacttgtcacttccctaaaacaggtgctcccaaaggcaattcctgcatgtcctagaggacttttgtgtgtgtgtgtgtgtggtctgtgtgtgtgtatttttaactgccgtttttgaaccaatgtaacatgatagaacatgtattaggatgtaattggttccaggttagttaagtaagaaatgcatttaattctttctcaccccttgaagaatatttctacttctccattaaataaatcagattttaaacaaaaatggaataatccctcaaatgtaattcaaaatacaacacacagtctcttgatttgtgagaattagctattgtacttcttcttttgaaaataaccctttaaacattaaaatcaacagatgacagctttagtaatctgagacaatttcatgaattgcaatatttacttatttgggaggatgttaaatgcttttaaaaattctttgtacctgatgtgaatatataataaatgtgtagagtatttcagttgcatgtaatgattgtgaagctgtaggaaaggtggctttcccaagtcttgagtgactgattccatcttttcttccctgactccttctctccaagtcttctaaaggtataacatctgcacagatgcagggaaggactgcactacaaagatgtgctgtcaatgagctttgcagactggttcttttccctctagccaagccttttttctttttatcctaaagaaccctggtctctttttatttcctggtcaatcttaatttttctaattttcaactcaaaaacactgagatttatctccatttctctgtcttaaagagaaatatacacaaagcagtcagagcattagctaactcagatcctattatgtgctaaggtctatctatctatctatctatctatctatctatctatctatctatccatccccttttaagattcacgacaaccccatgaattggtactattattatcttctcttaaacagaggcaaaggaaagctaagtaacttgtctgagatttcctggctgtaaagtggcaggaccaggcttacagtctccacagtttggcttttgagccaaccctcttaaccatcctgttaccctgcctttcaacagtgtaaaacaacaggagcaattttggtgtgctgcggaatgtaattgggggatctgggtcagaatggagaaaaagcaagagaaatttttcataggcagccaagaataaaagagcctaagagcatctacaccgatttctataacttaggctgtaagagaagtaggaaaagcattttgtttttctgcttaaacttgttgcacagtagaggaagataattttaactaaacttgtttgaggctttaagaagtaggcctcagagactcaaaaatcaaagtgaagtgaagtaaaattagcaattgttttctaaaaattcatgtaactcttagcaatgatttaggctttccaaacaacgtaaattatatatgcagattacttctaattataatgcctttccttctagattattgaacacttacacaataggattttaattgattctcaccagcctgcatctctagtgtttgattaaaaatatgcccattgtcaagaaaataaattcatttaggcatttataagcatttgtagaagataggtgaacaaaatttaaattaaaaaaatatagttatctacatttgaaagagttccttattatttaatcccttttgaaatatgcttagaatatcctttcaaggagatgatctacagatctttatttgaatctaacacttttaaacattttccctgatgtacagattcttgagttttgtttttgtttttgttttacattttgccactcaacaagaacataattcacttacagaattatttttgtgtgtctgtaacagctgtgattttccaccttactaagcagtttggaatttatcagtacatttctatttgtcttattttttaaatttttaatattttttaaaagaatatatggaatcgttaaatgaaatttacaagagttcattgctttggactgagttccagcactaggcccaacagaccagacaaaaccagaatggaatcgctgtgccacataatcaaactgaactttgaaacaagccagtttttcaaaagaggagatttacagcaaccaatcagaaggggcccagtttacctgagctggcatgataaggaagtcgtctctgttttaattccataaggaaagtaactttgaaacaaccacttctcttttgttcacggtttctgctttttcttagcccttttctgcctataaagccatactcctgatcagttcattagaacactcattctgttttctggaatgagatgttgcccgactttagaattcaataaaagcctattggatctttaaatttaagaaaaaccgggccgggcacggtggcttacgcctgtaatcccagcactttgggaggccgaggtgggcagatcacaaggtcaggagattgagaccatcctggctaacaccgtgaaaccccgtctctactaaaaatgaaaataaaaaaattagccaggcatggtggcgggcgcctgtagtcccagctactcaggaggctgaggcaggagaatggcgtgaacccaggagcggaggttgcagtgagccgagattgcgccactacactccagcctgggcgacagagcgagactccatctcaaaaaagaaaaagaaaaagaaaaaccaattatatctttaaatttgttgtaattttgtcttttgacaggatctttatgaagttacatgccattgacaatctttgctgtgttgttgtaacttcaggtatgctactgcaatgagcatgccagttggactcttagacaatggccatctgagtaagaaaaaatttcagttgttttaaaaaataagtgtggtattcattttgtaatttattaaaataacatttgaattttcaaactagctattccctgagattcagaagtctttttgcctgctttttttttttaagatgaagtaatctggctataaggaatattgattatattagtctaaggacacttacagagaaagtaagcttactgtagtgtgaatgatgcttctctttctattaagggtggtcattctaaatatgactgcataaggaataattctggcaaaaatcagtccttcattttctcttaagatatttagaatttaatttaaatattatatgtcaaggttaaaagttagaaacatgtaaggaaatatttaagaacttacaatatgaaaacctgttttctttatggaactctttggttatatgattggataggtaaaaacaaatttgtaaaatatggtagatatgggaaattgtcaatatatttgtaattcatgcagcaaacataatatttaggaagtatgttattctgttttcttaagtacataatgataagggttcttttctccaccaagccccttttctacatttgtggttttcatttttgctgtttttatgttattattgatagtatctcaataccaacctgctattgttaatttgtgacattccttatttagtctggaaagtggaaggtagtagatagttaaaagtttttggtgtctgatacagagatgtttatttaaaagtatagtaaacaaaattaaataaattgagatgtttttgaaacatggcttctctaactccgaagaactttgtgacaaaaaatgatctcttatgataatattttaatgtaaaatacaagaaattctttgaattaaaaaacattgtcttgattatcaccatttaggcatatattgaaagttctcatttaagtggtagaaattatttgaaatagtgttagtttcctgtggctgctgtaacaaaccaccacaaacctggtgatgtgaaacaactgaaattttttctctcactgttctggaggtcagaagtctgaaatcagtgtcgcggtgtggaagtccagatgtgggggagctctgctgcgttcccgcagaggccctggagaggaacctttctctttcctcttcctgccagtagtggccactcgccttctttggcctgtggttgcatcactccagtctctgcctctgtggtcacgttgccttccccttatttgtctgggttgaatttccccatgtgtcttttttataaagacatttgtgattcattttaagcccatctggataatctagaataatttccccatctcagaattcttaatctcatttgctaagaccctttttccacagacggtaacatttacaggttgcaggggtatctttgggggccatcattcagcctactctggtaatctttattcatatttaatcttcttcaaaggaaattgaagccaatgagaaaagcagtttcactcaactactctgagttggtgataaataaaaaatccctatttctccaactggtgttgcatgtaaagttacctgctatatattgccacctggatgggctgccttcgcatgaactaaattcaaataaacttaaaaaaaccaaattcatcatcttttttcctgaggtagcaactcctcttggctccgaattctccttttagagtcaccatcatcccagttatcgaggcttcccttggcagtcatctctgactctcgcttccttctctcccacatcctgtccttaaacgacctccctcttgagttttcacatacttaaaacatcaccagacacataagtccattgaaaccacctcaggcctttttaatttaaagactggggtatcatcatagcctcctaactggccacctcatgttagtattcccctatggcattctctcttatagccactgggttaatattcctgaaacactaccatggccatctaattttcctgcatagacatattgtttggctccttatttcatctgaagttaaatataaactcagcctggccttgatttattttgtagcgttatttctgatgctctcctcacctgacactttgggtccaggagcattgctctcttcacagccccctgggcgtgccatttcccacaacccgccacacccccacttctgacatgccttttcccaccttgcctttcaaaagtctactcacctttcaagatccatctgagatgtggcctgaagtaggacatttccctctctcatttctaagtaatgtctgccacattaccagcttgagttacacttttccataagcttgtcatccctttggaggatggacactgaatgagcaaagatgatgccttgtccattgttaaatttcttcagtgttttgcacagagtaagcatttaataagcatttctcaaatgaattttgtaaaggccaccactggaagtaatttgctgttttcacatcgatttgtatattcctcctttccatgtgcttctttgatcacatattattcataaaccttgtgactgtttttcatgcctaacatttggtcacaattttggctttttccttcttatccctccccccgcccaactggagtttaatttattttcctatatggtcctgtcagcagaactgttcagagaatttgggcaaatcaggacttcctgagagagttttacttgaattgcctgtaagtctgtaaatgttgtggggcatagaatgataggaaagacctctggttttcaatgctgaaggctttttattgttaagatatccaaaataggcatagcatgtttaaaagtaaaaaccctggacctgctctctctctttcatctgaaattatgtgtttgccagagtataatagctctagacaggaagttatgccctcagggcataattcttgcaagggagagaataaaaagtttagactcatgtcacatcctgaatctcaatcccttcatgtctgggcaatctgcagggagaacttttgttctagtcttctttgccagagagaactctggggttagcattttagtccacagtcccctgatgaatatttattgagtgcagagtgcaatgaggatatggaggtgaaggtggtgtggcctgtgtcttcaaggagcggtgtccctatagttgtcagaaagaaactccaggaaaatcctaaagagggagtttaaaattgcagatatcacagttatacaatcagtgttgaattatttccgttttcctcatgatcagaggcccctggagaggcactctggcattgtcctagtattactatcctgtggctatttcaattattgcttgacttcttcccaatgctttcactcatcttgtcatggtttgggctagaggttccttcactacacccactagcaaaggtgacaaagccagatttgtacctagaaaagtcactaaaatgctccattttccaactttccaaaaagcagcaatactgatcatactcataagtaaataaagctcattgatattgaattatctctacccaaaaagaatgtccatcacaatagtgttcataaatgagaggcccttctttgcaatacaaaggtaaaaaatgcaacataaaattgtatattgtgctggcaattaatttttacttattaatacattataacagttactttctgcctgatgtatttgtcatttacaaagacacaagaccttatttccatatttcagtcagtgctttattttgatcaatactgtattcatgtatgtaactctcatatcatactcttgagttatgttgaagttttaaacaactattagacaaataatgaatgttacatgttgggtacaagcatcctttgaaaaatcaagaagataaaagcaaagccaagagtatatgattcattttaatgtaatactgggataaaaatgtgaggatgtgatgtcaaatggtaataaatgctgagttttcccaatgatatgagacaaatttgacagaatacaaaattttaggaacatgtttataaactaaattagtctaatgttcaatgggaaaagtggaatttgatttatttatgttttgctttactgcatttattaatttttaaataccacacaatttattttcaaggtttatttatcttcatgtttacttgatgtaattctattgctcattatattgcacagagcttgtcacctataagaataagagttctatgaaaatggatcattttaatgtgataatgaatggaataggagtttagcttcatttcatttttcatgatagaatttgtttcggaagttcctatcctccatatcaatgtcacgcccaaatatttctggcttaataggaacttctgaaacaaattctatcgagaaaaatgaaatgaagttaaattcctattccactctctgacccccgtctctcctctgtcttcctcctggcctcttgcctccccgcccttctccctccttccctctcttctttctttcaccggagggcactacagcatttaagcttacacccctgattgaggaccgtccctttcttagggactccagaagaaacacctgcaatgttgagacacgaaaggcaagagtgatcctggaaagccaaatgggtgcctgtagaagaggaaatgatgcacagggattttgctttgattcatcaccaggttgactaggtgaccaggcttcttaccattcatgtgatctgcacctgtgatcaaaagccttctttatattctgtgagaataaaagaggatggccacaaaatattctataatcttctcagtgtattgtacttcatatctacaacaatattttgagcacctactaatataagggactgtgccttgtatccaagatagaaaaaataaaatagctcctgctctatttggggaagaaggtcaaaatcagggtaagggaatccagaggaagcaaaaactgatactgacggagtctgtttaagtaaaggcactgaattgtggaaaggtaaaacacatatgaagactggaattcaaataagaaggtctcccaaaagctgaaatgcagaataatgatggtagataaaaataatctctgacctgagatggtttttcatactctacaaacaagatgggatttgttaatagaatacacctactgaaaaatgagactggagggagctggtgggaggaaggaatggcctgagagaacaggtgggggaagaatagagattcagaaagattccatcaaacacttttgcagctgccgttctatactggtttgaagtcctagtttgccttgatttacatgtgtctaacagttgactctactggtatatgtgtctccagctttaagaagaagaaaaaatccactctaatgacggatattagttgccacttaaagatgctcttcagatactagtgttccagttaaccattaaagatatataacccctgtacaagttggcaaccataccaggtcattgatttattatcattaaactgcctaactagtagttatgttgagatgaatgctgggtaaaatattacaatgaatgctaaatgaaaaatacatctcaggcttgtaagctcccaccttgtgtagtatttctgtgttccctgacaccctgaagcctaatcgtgccttctgtatagttttacatgtgtagactctcttcttcgttacgatttgccaatcccctgttgctcacattgtactacagcaataatctttgtcatttttgaattggtgtccaggtggttgctgtcacattacatccatttttaaatgttgctcaaacccactgaggtgacatgcagttttccaacagtgtgaattttttttttccaaattttttctcttcgatggaagaaaaatttgctgtcttctttgacagctggacaagtagagattgcaatctcctttccctctcagtattctctggcaacatcatgaataagcaacattttagatggttgacttccaaaaaatgtttcttgtcaagctcctgtcaggattttggaagtcagggaacaacttttttccagttgtgattttctataatttcatttctgaagtctgaattatgatttttttttctttctgggtttttttttctgtagtaaaaggcaggatgggaagaaaaagtagctcagttcctttttgtgttgatgtagagggtggtacatcattggaaatctataatgggattttctaaactggtagtttaattattgttatattttaagttgaattatctctatcatgagccaatgtctaaataaccttacagtaatcatttttatggtatcagatgattttttaaaatattattacatttcatacttacaaaagatactgggaaatacattagacatttcagaatttctctcagttatgactatgagaatgaaaagaaagtcttttaaacagtcctgggattttttttttctgctgctatctagtctacttcaagttgtaattttcagtggttcttgttggtaaccccaatttaggccactctagagataggcctcgacaggattatatatagagagagagctcagcttagtcgttgagagcatggactcagaagatgggccagccctaaacctgattctgccaggattcatgtgaccttgaataaatttcttaccctctcatttgctcagtttcctcatctgtataatgaggataataaaaatcatatttactccatgaggttgttgtaagaattaactgagtgaggctgggtgtggtggctcacacctgtaatcccaacactttgtgaggccatggcgggaggatcacgagatcaggagatcgagaccatcctggctaacatggtgaaatcccatctttactaaaaatacaaaaagttagccaggggtggtggcatgtgcctgtagtcctagctactcgggaggctgaggcaggagaatcacttgaacccaagaggtggaggttgcagtgagccaagatcgtgccacagcaccccagcctgggcgacagagcaagactatgtctcaaaaaaaaaaaaaaaagaaagaattaaatgagtgaatatgtgttaatctcttaggttagtagcacatagtaggcattgtgatggtaaaataatacatacatacctaatttatatccagcctcacattttggtactgggaaactggatatcttgttcaacagtggtattcatagtttaatctcggcagcaacaaagtgccctggggttcctgactgaggtagaagaatttataagtgtaagctgtttccattttagtgtagtctaaggtaaccctctcctttctttttttcctgttatgagtaagcttaattttttttaatatatagagtttacctttaaagaagttaacacatcattaagatctaggtaccttcttcaactctccccattcactcattccatttcaatttcatgtactccaatcaactttggtatgttttgaaatgttattattatttatccaactttagaaggttctggtagagttagttcctgaggctagggaaattcttttaattaataatctttctgttaatcaccccataatctccatcagctctccaatccaccctgtctgtggccagacaggactgtggtttagttcaattgccgtcaggatacacatacgcaattcagtgagaattttgccaccatttttcctctttcagaagttgattacagaatagccatcattcaatgaaagtctacaggcttctctaattctcttgcagttcacagtcctttagccaacagcaactctacaccatcaaaagtaggatttactgaggtatcacttaaattcccccttgatttaagttcttaagtttcaggaccacttaagtattatgaatgacaaatcaacactcacatagtattgcagaagtatagcttgagtaagtctaatggggaacactttttttacaagctcagggtaggggatattttttgtcactccctcaagcaagcgaactacaccagtagaattataaatcgttctcaactctccctccctttctttttgttccacctccagaccatagtaggggtttaaaatttttggtgttgttgtttacttttttggtacttcggggttacctgtggacccctttccagaatattttacaggcatacgataaagtgcaaaaacttacttaggaaatcagttttatggaaatatactgatcacgattttgaaaaatgtgaagactaatttatgtgcttttattttaacacattaaataacaacagctaacaacaggtcaaaaaatcactgcaattcccaagtactgatgggtataagtgaaatattgagatttctatagcaactggaatctaataggaaaataactgtgatttctgctgttgacatagtcacaagttttcctgaaactactttgcttttttccctcattcacaagtgaaggaaatgggaagattcactcagagattagtgaaaaggatatttttttttctaagttcatgaaccctaagtccctgaggatgcagacatatatacatctagttttctatccctgaggagctttatagtctactgggagagacaggtggcaaggtcaaagagtgctgagaagtggggccactatcaccccataatcttcatcagcccttcaatctaccccaaattatctaatacaggcacacttcagagatagtgtgggtttggttccagaccactgaaataaagtaaacagcaataaagtaagttatgcaatttttttggtttcccagcgcatatggaatttatgtttatattctactatagtctattaggtgtataatagcattatgtctagaaatacaatgtaaataccttaatttaaaaatattacttaaaaaatgctagcaatcatctgagccttcaacaagttgtaatctttgcaggtggaggctcttgcctcagtgttgatggctgctgaatgatcagggtggtggttgctgaatgctgggatggatgtggcaatttcttaaaataagaaaacaagtttgacacatggattgactcttccttttatgaaagatttatctgtagcatgcaatgttgtttcatagcattttactcacagtagaacttctttcaaaatttgtatcagtcctctcaaaccctgccactgctttgtcaactaagtttatgtaatattctaaatccttttttgtcatttcaacattgttcatagcatcttcaccaggtatagtttccatctcaagaaactattttctttactcatccataagaagcaactcttcattggctcaagttttatcacaagattgcagtgattcagtcacgtatttaggctccacatcttcaggctccagttatcttgctgtttccaccacatctgcagacttcctccactgaagtgtttgaagctgtcaaagtcatctgtaagggctgaaatcaacttattccaaacttatgttcctgttgatgtttgaattttcttccatgaatcacaaatgttcctaatgatatttagaatggtaaatcctttccagaaggttttcagtgtcctttgcccagatccattggagtaatcactatctatgtcagctatgggcttacaaaatgtattttttaaataataagacttgaaagtcaaaattgctccttgattgatgggctacagaatggatgttatgttagcatgcaagaaaacaacattaacgtctttgtacatcttcatcagagctcttgggtgactgaatgcattgtaaatgagcagtaatgttttgaaaaaaatctttttttctgagcagtaggtctcaacaatgggcttaaaatattcattaaaccatgctgtaagcagatatgctgtcatccagactttgttgctccatttataaagcacagttagagtagatttaacatagttcttaaggaaccaaggatttttggaatgctcagtgggcactggcttcaatttaaaatcatcagctgcattagcccataacaagagagtcagcctgttctctgaagccttgaagccaggcattgacttcttccctctacctatgaaagtcctagatggtatcttcttccaatagaaggctgttttgtctagattgaaaatctgttagttagcgtagacacttttattaattgttttagctagatcttctggataacttgctgcatcagcactcgctgcttcactttttacttttgtgttatggagacagcttctttccttaatcctcatgaaccaacctctgctagcttccaacttttctcttccagcttcctcaccattctcagacttcatagaatagaagagagttagggtcttgctctggattaggctttggcttaaatgaatgttgtggcaggtttgatcttctatccagaccactcacactttctccgtatcagcagtaaagggctgtttcagtttcttatcattcgtgtgttcactggagtagcacttataatttccttcaggaacttttccttcgcattcacatcatgggtaactatttggtgcaagaggcctagcttttggcctctctcagcttttgatgtgcctttctcactaggcttaattatttctaacttttcatgtaaagtgagagatatgcaactcctcctttcacttgaacaactagaggccattatatagttattaagtggcctaatttcaatattgttgtgtctcagccaatcgaaaagcccaaggagaggaagagagatgggcaattgctggttggtggagcagtgagaacacacaatatttatcaattatgttctcctttttttatgggctttattggtggtgcccaaaacaattgcaatagtaacatcaaagatcactgatcagagatcactataacagatacaataataatgataaagttagaaatattgcaaaaattaccaaaattgtgacacagagacacaaagtaagcatatactgttggaaaaagtggtgctgatagtcttgctcaacacatggttgccacaaaccttcagtttgtaaaaaaaatgcagtatccgtggagcacagtaaagtaagctatgcctgtatttaaaaaaataaaataaaaaatagaataaaatcttaggttgaatattaataaaataatgtttagaaaacattagtatttttactgttgcataacaaaatatccaaataaaacttacatgttttatatgtgaatgccactttacataattcccttagctctgctttcaaagtactgttgctgcccaatgtcatatccccctccatccatttttctatatggaaattctggagcccccactgggttttaaaacaaaaaataggttaaaagttaattgcagtctcttaacattattattatgtcagtgcaatgctgagaacttgttggttgagtgatggtggcagctgttacacagtggtcatatggcagattgtaaccctgaggcctatccacaattcaaagctcatgtcattgccagctagtgtgataactcatacctggcatttttgtttactagtgcaaatggcactgacattttgtgaaaacattgtaaaaagtttgattcatttggtctatttgaaattaagacaggcttgatgagctctaggagcattcacaaatttaaatttataaatagagatgttaaagtattttatattactttgtgtcataccattcataatgtactcttccttaaaagaaagaggaaaagaaaggagatattaagttaagtgtgttaataggttataccagtgtttgcatgttagatagtcatgtggtttagcttgttacttggcatatgtggccccgattgtcacatgacaaggcacctgtggtgactgtcctttgttcacagctgcagcctcagctcatgccacagtacctgaaacctggtattttataaagatttgttgaatgaatgtatgggtaggtaaatgaatggatagttggatgcctgggtgtgtggatggatagaattttttttaaaaaacccaaaacttccttaagctgtagttagtcatctataacatggaaataataatacgtaactgataagattattatgtgaattaaaaacaataatgtatataaagtacttagcttgcatataagtgggaaataaattgtagcattaataaaaatatataattctggttctattaaataactaaatattttttgccaataattaaaactgactgcttttgtgagtctaagaaacagcagtgaacttggattacagttttatattctttgcgtctagaaagtgatgtttcatcacaaggcaagggctttcttctcatgacaaagagcctgatgtagctgcttaataactgttagtaacactgaaaggatctacagtaaatctgttagaaagctgtgatcaaaaatgtgagtgccaatcttcaaaagcccatttcaaagcttgtttgctataatactatgtagtggtttatttgcctttctttgtaactcattaaattaaaaatttggatccatcctcatggggttttcagaaatggttttataatttagcattccaatgacacttcttatttgcagattattatatactagtttttttgtcccactgtctcaccccagtgtagattattaagtccatatcattgcaatttgccaaaactctctggataaatgtctatgagagccaaggctccattttacttgtttatcgaatatggaattaatgaactatcttgaaacaatgtttataactaatgtttatatgacagaaaattggtgctgatcgtagtgtacatatgcaaactaatgctattttgttccccttgcctgaactctggctacacaggcagaattatattgctgttgtgttcaaacttcaaatacaatagtaactccagatgccatttttgtgttcttgtgaacttggagtgggtaaccaaaagcaaacaacaaaaacaaacaaaattgggacaggtgagaggcagtggcatggaagggagtgtaggcaggaaacaaataatatgatgactacaggatactacattctgatgaagactttacacttatggattgaacaactgttagaaaaagatcaaacatattatttgcacaggggtaatgattattttagaattacttcctgtcagtgataaatagctttatttaagcaaaatccaacctcttgaaattgttctccccttcagtgttatttttgtcattattttttcttcacttaaattacatataactgtaaagctctttgaaaaagtatattatctaaatgcatctatttaaattgaatgggtattaaatttattaaacatatttacaaaatataagtaagacatgaatttaatatgagtctgttgaatttttcattgtagttgaatgaatgaataatatattctagtcagccttttcattttctggtgcttctttttagcacccatagactttcatatattgtaaacattttcttctctatatctagttttagaaaataaaatgttgggaacacagaattgacttctggagactgggaagtatataactaaagtaatatgtgtttgctttttctaatttaattttgattgtggtgtgcttaatttataatcttttaaaatgttttaattttactcaaatagatctgtacatactttttatactcaattaacataattatttagctatcatacttccgtgtgtaagatttctagagcatcgccataatgtagcactttggtttgcaggagagaaattttcatggtacattatttacttgcattcaagtgaaaatattgttaatattggttgcatttgaaggattctttcaaaagtacgtggtgctcaagatggatttaaatggaacatgcaagagacagtaataacagagagatcacattctctctgtaatttattttaatgccattacacagggaattcaaggcagataaaaaactccatttacagaaaccaaatgtgcagaaatggattgtcataattccagatgaaatcaataatacatactccctggcatattttttattagaaataacttggaaaaatttatattttctactaagtaaatatataagttataagaaataacttatatattaaataaataagttataagaaataccatatattaaataaataagttataagaaataacttggaaaaatttatattttatactaagtaaatatacaatcatagccttaagatcttttgcagcattactttccccttgatgaattacaatgcaattttctagcctactcattttattaaggaagctaatgactggagcaaaagtctaatcagctgccaatcaggattccttgaagtgcagagtgtcaaatattgaagcaatttttacaactcataaaagcacttatgttccatggtatgtcataaaacttgtgatgaaaatctagcattgatgaagctaccttatttctcaagtgtttttccccaaacaaacagctttcaaatttcaccaaatctttcattaatattcaagtctattaatatagcactattatgttatctgttatagtattatattatccaactatagcaagataattagttatatataaacgtcagtcagagaacttagtggattcatcataaaagctgtaatggtggaatttttttttccatagtaaaaaaattggtctttcttctgataatgttagagtgggtttttgtttttatgttacagaaacaatgaggctgcacactttgctttcaccctttgcatcattatgtttgcattgtttatttttaacataatggtacattgtttcatgaaaagtaaccatatttcaaatcattaattcacttgtcatttatcattttaataccagaaagtagttaccttcctgtgtttgaaggtactgtataattgtatttctttaccatgtcgacttcctgtctcttaaaacgcagcaattacgtgtgtgtttgtgtgtttcttcatctgcttcatgcatataaatatgtgcgggtgtctggggttttgttgttagctgagaggtgggaagtgtttccacacatctgaatatttgctgccgaccttcttgatgatccgtctgttaatgtttttatcaagctggcacacctcatgtgggatcttaataaagtaatcagcattttccctctaaaacaagtttgagaaaatcctagttaaactattctcttcaacacttgaaggccttggttgtacagcaagcagctactaattcaggaggatttatttggcttttcctgagttctctgaaaaatctatttgtgtaaaaagaacatactgcatgatccccagggctcctggaactgaaaactcaaggatttagacgaagctacccagtttgtttaatcatttgaagttttgtttcagcagctcatgctttcctcttacattttggcagaggcagaaatctcagatgattgtttttgggtacacatgtaaaaattttctcattaaccttgggggtggtgtaatgataaaagagataacattttgtttcaaaaaaataatactaactgagcacatatttcaatgcattgcaaatctgaaggaattgtcatggctaacaccatctcagtctcagtatttgtgccccagttttttttcaggtcaagaatgtagggaaacactgtactaagttctcattggatcccttgatgcctcataagacacccagacccctagctctcaatttcatttctaaatgtaccccagctactagaatctctctcacaatgatgacaaacatcctctttaataggacagataaatattcctgtcactcttgactgagagacaatactccaggtctaggggacatgatctgcaaggaacttcccatgattcaggcaccactattcctgttcattttttttccattgtcccgggatttacagctttcaggagtaccttcatgttactcttctcataagagggcaacaccatatttttctcactgaatcagaagacccaacaccacctctttccccagagcactgccatttgcatcctatccagctaggtagggcaaaagtgtctttcattagactaaggacctccacaggcagtgcttaattttcatttacctttgcctccatagtgccttatatgtagtgcctaaatacggatggtgggtgactgcttagagtaataatagctaatatttttgtgacattagaaatggacacagtggtaatacaggtcaggattataactcaaaatcttggcaatgtgatgtttattggaacaaaggaacctaaagatcagaatgctttctctatgtaagatgactaggcctgtaaagtagagtgggtcactattctacagaaacacagatatcaatatttacattacaaataagatatattaggccattcatacaatttacaaaatggttcattataggactcactaactgaaagtacccaggtgacattgaacgtccagtttattttcaatataatcttcctgaaatctctgtattaatttggaaaaagtcaacaaagtaaaccattcttaatgtaacaactggatttaaactagggaggatcaaaatgtttaggtaacagaaactagcagtccaatgtggatctttctactttctctctttttgcctttgcctttgtctacgtctactttctctcctttgcctcttctttgtttatttaaacatatatatatatatatctatctatctcacatactcagaggtttattgcttagttttgttttttataaaaatggagtcatactatacacactactctgcaacttatttaagagtatactatgaatattcagttgggtcttattaaagatctaacatcctttttaattgctgcttaatattttgtactttataccattatgtatttaaccaagaatgtctttattaaataatataatcttcacctatgccagttaatctgttattcttagtgatttaagctcctttctctcatctggaaaatacagcaataaataggtaaaatccacagtttctccttcaagtgctacgtgcaataggcccatgaggtaacccctgaaattcatgttttcttggaagtaatcagcagacctggagtcctgtgtatgtttgtgaactccagaggtccacactccttcacttcacactcagtgtcctccatacttagggcttctacccccctgcccagttttgttaaagaaattactccttgggacatggacaaaataaaagaaatagccatttgtgtttctgtatccaacacttctttgtcctgtcatgggttcagttagttctaccatgaagtatggactgtctggtaagaggaaagagttttagagattaatgagggtagcactagtgaaactagtctcaaagatggcatagtcaatttcctcagatatagaccaatactgatatctaaaaagtttattcttatgggtagggatgtctggatgatagcaatttaagtcttcaagggagagcatctccgttgcttataggaacaatcatctggactaagtcatgaccacagttctaacagggaaagtaagcaagatccagctcccgaagaggagtttgcattggctgcaaaggggatccaagaccttagctcagtgagccaagcttcagggaaggactgcagttcccttagggacatagaatgctaacaaagaactggttttggagcttggtcatggggctggccatacatgttgggggctggcatgtttatatgacaaggtatttaggctttccacacctaaatattcagctatatctctgtaagtgcatagatccctaaagagtttgccctgggtacattgtgctggttgtcagataagaataccgaggctaataccagggccctccctttgttagaactctacatctaataaacacccaggcttggttctcattgagtcacaggctgggtggggctgagcctacaggttgaatattctcagttcttgactctggatccaggtggagtatgcatagactgataacaacttgtttttgcagtaagtctgaagattaaagcccttagttgagccaataccttccttctcagataagtcaaatccacatattcagaatgggagcaggaggcagaagggaaaattttgtaacctcttaacagttctagacttaacacatcctactatcaatctgagtggatttgttccagatgcttgcatggctgagatatgcaaaaaactgtctccccatgctgattggtagcatctttacatgggcaagtcttcctacttgtaaagaatgagttaggtgtgtctgggacttactaaggagtctcaggtgttgacagcttaaacaccttgccatgtaaatatgtctgatctctcttccagttcttacacagttggctgtggttactgacttcttattttgttcaggtctaaatgaaattgatcttgatctattactttaccctaggctggagaaacaactttagtaattatctcctcacccctacttcccttttgagctttgtaaaaatgattaaggagatcagaatatatggcataaattatcaatggttcttctccattggaggttagagttccactgtcaaaaattagtaattatcattcttcttacaagtttaagactcaaatggaactgactttttcagcctatttgttgtctatggtaaactaacagcaaacagctggatgttcttctgtggttacataaccttaatggagattagttccttttatccttctatactgcttccctaccaaatgattagattttttgaggggcagatataaaccccttccattgtttaaaaaacattgttaataacccttcgcactacacaccaaagtgcagcctttaatatagttgccagaagcagttctgagtgaaacactgaaatgaaaagtaaactcatgtcatttggtctatgataagcattcacagtttgaaaaaccccaaacagggatagttaagttgcaagcactatttccagaatgagagttgaaaattatatacataatgtggaaacaatagatcaatgaaagggagtatagaacaaaagagagaagaatttccatagccactccatagaatattaggtctatagaatgtcaagaggggttatgtccaaaacagggttctaggatcagataagtttggaaggtacagaattaaatgtcattaaatagatttacttcttgcagtattactcattatgcactgtgaatttccaagacagggacagcgtatgctgcatttcccaaacttgtatggtctgatgaatccaccgaagacagtgcttttatagggggacgtcatgatgccaaagagaaaagagcttaagaaaggagttcaacaggtcaagaagattagtgcataggaacttacagaggggaaattggtgcctccacagcattagttagaactagaccctgatataataggggaccagaagaaaggagggcatgaggaagagaggactgggctgcacatcctggctttgactggaacatatttcccaaatccttggtgatcaaagccaaagtaaatacaaccaaggttatataggagtaataagtgatggaggtagggagtcagctggatgaggcagagactggaaatccttgttttgacctcaagcctcaatcctgaaccatattgctatattgaaatatagtcaagaaatgaatgtatcatgcatagtggcatgtcaggaagttcaagtgtgagaaagccactttgttataggcccaattcctggaggaggatatatgcctctccagatccatttggcttcacttgtctccacagctgtggcaatcagttctgcatggactccaactatcttcctgtggggactgccgaccagtgtctcatcaaatcccattcccactgcggatttctgtgttggtgctacctggggaactcaggctgaggcagtgtctcacctaggtagcagcctctgtttcttgtttatttagagagtaattatgaattcataaactttcatattattacaaatcttactggagtatctagtaggggcttagttatatgctaaacagttgtagtttgaaaagccataataactctggttatttgacagatatcaaggcagggcaaagagatacccaactagggtaggtcatcccatcaatattttggaaacatatgattgcctcacattgtatatccttatcattgttttcttttaattattttacatataagtttagacagttgactgttgggaattcctattcagagatttatcttttaaccccaaatgattaacctgtaagctgtgactttcagtgttctggtattaacaataattttacacatttcaaaattatagtggaaagtaattttaccataatattttatctcatataacaagagcatggtatttcttttgtcgaactgcagcttttgtagataccatacacattattaatttcaaacatatcatttattccactagaattccattttttcttacctaatttatttccctttttaatactgagaaaaacagtatgagattgactattgaatttaataagatagtaacttaacacaataactaaaaacattggaagtttaaaaacaacagttttttcctaaacctgactcgaaaaccattgacattttagcaaacagatgggttttatgtaccacataatgaggtcctgggctcactcaagaccaccaggttgaaggaattctaaagctggagatcttttaaagatggcaaaatgactatgagattatctaaatatataattaaggaaaatagatcttttctgtttgtccttggtaaagtcctcaaggttgcatatgaccttccattaattttcttcagtcccaataggtgtttattttgccactgggaaagaattaggatttaggtaatgtctttgcctcacacttaggcttcctaacatgttataatgcactctatgttcatttcttgcctgtgttgcagtatagcaatatggtgaggactaaggtttagagtcaagcaattcaggatttccagtctctgccccatcatttattagccgtgtatacccttggttaagctgattaccctctctgagccttagctcatgaaatgagggccatataactcatatcactctgttgcccaggctggagtgcaatggcgtgatcatggctcactgcagcctcgacctcctggactcaagccatcctcccacctcagcctcccaagtagctgggactataggcattcaccaacatgtacagcaattttttttttttttttttttgagacggagtttcgctctgttgcccaggctggagtgcagtggcacaatcttggctcactgcaagctccgcctcccgggttcacgccattctcctgcgtcagcgtcctgagtagctgggactacaggcgcccgccaccaagcccggctaattttttgtatttttagtagagacggagtttcaccatgttagccaggatggtctcgatttcctgacctcgtgatcttcccgcctcggcctcccaaagtgctgggactgcaggcgtgagccaccaagcccggctgcaattttttttttttttttaagagatgagttctccttatgttgcccaggctggtttcacactccttgcctcaagtgattctcctgccttggcctcccaaagtgctgggattacaggcatgagccactgcaccttgcctactataaaccttaaatgatataacgtgttacagcagactgtgttaagagacctcatttgtacacctcaggtgttctttactgagaacacttcctattccttgcctttattctggctgcaggagcatggttggctcattccaaggcaaactggaagtctacaaaagtaatgcctcaaaaagcagtcccctatttagaatacctctgaggcatgttttacacgttttccagagttccccagcagaactgatgtccagtcgcccatagaagttgcttgcttgacagtacctctttccctttctttcctgaccgcatttctttgtccccttctagtaggtttcctgggatctcttttcaaataaattacttgtaccccaatttttgtctcacagtctacttctaagggaaaaataaggtgtgaaaagcacttagtattgtgtctggcacataatatattataataattattaatttcagaaacatatttaattcgttcttttttagaaaaagaaaccaaaagtgctatatttttgtaaaccactctcatggtagccacatcagttacagttatttttcattttctcttattgtttttaagaaatcattctttggctagtctcggtggctcacacctgtaatcccagcactttgggaggctgaggcggatggatcacctgaggtcaggagttcaagagcagcctggccaacatggtgaaacccagtctctgctaaagtacaaaaattagccgggtatggtggtgggtgcctgtaatcccagctacttgggaggctgaggcaggagaatctcttgaacctgggaggtggaggttgcagtgagccaaaatcgtgcctttgcactccaccctgggagatggagtgagactccatctcaaaaaaaaaaaaaaaatcattctttgaaaacttgttttctatttgaacagcaaaaccaggttcaacaagtgaatttgggcaatgactttacatgcactaatttttctgccttttaaaatacaattttctgacacctattttggtctggcagttcatctgaaaaataaaagcagaattttaaatgtgtaggtaagaaagattctattagtttccgacagcactgtagaaaaacaagagctctctatttcactaaaagcgctcagttccccctttttagcaaacactgaacattgatagtgtgttatgataaattaactacaatacctttggaggtcaagtgtctcagaaaaaagcaacagtaacatcttaggcaaaatggaaagcattagattcacacctgtaactcattaattttaaccaagagttagatttcacagaaagcaattactaggatggattgagttctttcatacacagggttgttttttttttaattgtaagactgttaaatattttctctgactatagttgccctcagcaatatccagaactagtggctatggattacttcattgtttctttctttggtaactgagaaaggtttaactatttattacaacgtttaaaaagttagattagaagaaaggatgcttccatctatttcatctttgtattctaaaagagtgtagctctactgtcagtggaataacagtgtgataaatgcactaattacatctgccatacaaagcttatatataaatccaaagtggacactgtgtgtgtgtgtgtgtgtgtgtgtgtgtgtgtgtgtgttttgagggtgtgcttgtgtgtgttcctgtctgagttttgcttctgtggttgttcatttgttaacagttatctgtttacaagctctttaaagatgaataacttagttattcaaacatgataaaatcgtgtttggtcgggtcttggtgttaaaatttacctgacctgactcttctcaaatgtctctctttacaaattccagtaactttattgctaagctataagaggaattttttagcttatttttgctttgagtctgtttttaactttctacaaataatttaatatcccttctctttgccttttcttaatgaagcagcatttctatgtgtctcctttcagggatgtatgtaaatgtagctatattgttgatagattaacataataatcaaatagaaattaacttcctgtgattcatcagtaaaactctatggacctacttttactcaaaattgttgctgtcaagcatttcaggtatgagttaattggctttctagaaaatgatagaggctatcctaaatctcaaagctcaatgatatctttttattttctgagatgccatttgtcaccatagcttattatacatgggctgattctcactccctggaaatagaaatgaagaaaggagctgtagggtcccctgccgccttctataaatgagcaaatcaaggaccagaatatctgtgggactcctccagaagctcttacagttacttacatagctaagtaagagcaaaggctggaagtagaacccacttttcccatagccaatccatttctcttttctaccaggtgtcttgtggcatttccccaggggactacatcttatctgctgtagtagaatcatgaaggtcatgaaatactggagctacaagagatttcggaggtctgctcccccccacccattttatacttcagaggaagaaactgagtacagagagttgggttgactaagaaattcatatagccaattggcgatctccttatagccattctaactttaaaaaggtggggattaaacctgctttcaaagcacaacctgaactgttccctcatccaagcttaagagagaatccatgacaccatataaaacagctctttatttccactggcaacaatggatgtatcctagttcatttgaacattttcctctctctatgatataggttagctggtttatttctatatccttgccaaaactggcagtgcatataggctgaaccatgcttgtggagaaaacactattcatatttcattatattaccttcagcagccctttactggcattatgactaaaacgcgtgtctccgagttgttgctggagaaatggccggccagtgaatttcgcgtcagaccagtgactattccagttgatatgaaagatgtcattactctgggggttatattgtggtcatcaggatattttctagtactcctggttcagaattttggagtattcatcttgaaaattgatgtctgtcctctattttggggggagattttctgtgtgctgtcttggctttctttgtttcctaggctataggtaagagttaagacgtacatgagtgtcttctagttaataaacctcactgccttctcacatggctgctgtacatacctgtcataacatgtatgtgatatactctctcccacacatacctatgcacacacagactcacacactctcacaagaagggaaatacataccattcttgccataatgttatttcatacatttgtgctttatttaacatttttcaatgcattagtattatgaactcttaaattaatgtaccaaagggcatttacataactttgaatatgttgattcaaaatcattacaaaatataatctaataagttacagagcctcattcaatgattccagttagcatccgcttctaagcgtgctattacttattcattagtagaagccctttaattttatattctgctcctggcagttgtggcttatttggtacttgttacagccactttagacaagtaaataaaaatcagatgaaaaatcctcagcaacagctggaaataaaccagtagtttctgtttgggtttggcagagtgaagcactgcagggctatgcatggaaaaataccagccagaactgttacacactgtgagaaaagattacatatctctagggttttggccttctaattactagggggtttctttgtccatgaagagtgccacctgcgtggttgggcaacaatataaaataattaaatcattatcacaagggtaatagtatacgtctttctggtttagctgtgataagaaaaccttaaacctgaaatacattaaacagtgtagaacatatgaaaagcctctttgagaggcttattcttgttgttatttaaaattttccttcactaatgtttagttcaaatacatgataattctagggaattacccgtctttatcagaccacccaaggaaggaagatgctctgccaataagtaaagccattggcctgtaagaacttgcttctgacttctaagtcacactcattttgataagcagatgtcttctaaaatgactgtgtggcttagcatactgagctgtttttctttccttttccaagacagtatggacatagttaaaaaaaaaaaaaaaagacgaaagattgttaagtacctgataatttcaataacatatttgtagtaactgcattgcagttaagccttatttaaagtaaattatctattttgcatccttttttttcaataaacagtttcacttctaagatgatgagggaaaaaagatgattaaggtttagcaatcttgttgcaagcttatttaaaattagttgtttaattatctacttcagatattattttgccaactggttatgttcatgccctgattaattattcttttcttccaagttatactcattttggaaaaatcaggtttagccatagcatgtgaagcccttaaaattgtctggagacagatatcttgatctcagaaacttaaattatcttaatactttctggagtaagaccaggaatggaagaagaagagagaaatatttctttatttttcctaattttatttcttctttcagcagaggaactgtactcttaaaattagagggtcagagcccttgctctgctgctgaatttatctcttacttgaggaattaggcacaatctaaacccagtactatttatttctccctttagaaattgaggaagttacctatggctaatatttttcaaatttatgtattttgtttgtttgtttgtttttttgggagatggagtctcactctgtcacccaggctggagtgcagtggcacaatctcggcccactgcaacctccgcctaccaggttcaagcaattctcctggctcagcctcctcagtagctgggaatacaggcacatgctgccatgcccggcaagttttttgtattttagtagagatggtctttcaccgtgttgccccggctggtctcaaactcctgagctcaggcaaaccacatgcctcggcctcccagagtgtgggattacaggcatgagccacattgcctggcctcaaatctacattttaaaaatattttaaaatagcgattttcaaacattaatatgatcagaatcacctgcagggcttgccaaactctagactgttggattccacctctagagtttctgattcggtaggtctgggatggatctcccaaatttgctttctaaaaagttcccaagagatgcggttgttgctagttcctgagatcacactgtgggaaccaaagccttacaataactagcctttttcatgagagaatggtaaggaaatataccacatatcaagagaagttatctcttgggttatcggaatgttagtaattttgtacttacccttttttcctctattctccatatgtcctacaagttatgtataatacatatatgattagaaaaaataatgaatgtttttggaagaacacttgttgaactagaaattcattaatctctattcattcttcccttctgatgtcttgtagcaatataataatgtcagttctcctcacctgctggggacagacactcctttcgatgtcttttgagggagctttcactcagcaaccaccagacagttgcttggttccttttagagtgctgtctttattgtgccagaatttagtacaagaggtgctggctctccaagatgagcaaatcccttaattgtatttcaaaaattctccccagttttttttctctctaccctcctcaggttacaatgctaaaagttctgtgtgggcctaaacactagtgggaaaaagcgcctggtgaacaaatgctgggtggcatgcccactcagacataaagaagttctgctcacccttttgggagtgtactcatttttgagaaatttgcctcacttagagctccttaaaataaatcaaacaaaattatatataaaatatatgctttcacaatttcagccatttcttttggtgtttctcttctaataaccttctaaacgttgttgctttatgtttttatctcagatttttgaaaacaaactaaatatagcaccctaaaaaacctttcaaatattttggattcttttatttatgactcttacaagcatgtgagggggcttgtttagagagaataaaggttataacctggtctgtctgttgagacagtgattttaatcacatttaattcccattcactctgtatgttacttgatccactcattggtttaaaagcatattgataaatacagccatggcttagcctcttgcccttcatcccgtctagagttgcatccaggcttaagtgagtttgccacatttagatgtcatactttgttactgatgagatccttgctagatagtggagcctatgtttttctagagaaaagtccatattccattataaagataaataaataatttgtttcagaaggctttcaagatgttggcttatagtcaaactataagtaacagcttgaaaaacctcagtgcttctcacatacatgttaatggctgttctccttcataaatactttgaagtgtttcagtaaatattttcctaaagaactttaacttatttgctaacttattgagtatcaaaatgtatgttgtatatgacactatgctaggcatatatatacaatattatccataatttttctaaatttttttgcaaatcagataaatttttattttaagattcagggggtacataagtaattgttacatgagtgtattgtgtgatgctgaggtttgggcttctaatgatcccatcacccaagtagcgaacatagaacctgataggtaatttttcaacccttgtcaccagccctcgatttctccctcctctttttggaatccccagtgtttattgtccccatctttctgtctatgcatacccagtgtttagctcccacttataagtgagaacgtgcgatttttggttttctcttcctgcattaattgacgtagtgtaatggcctccagttgcatccatgttgctgcaaaggacatgattttgttcttttttttaatggctgtgtagtattccatggtacatatgtaccacatttcctttatctaatctaccattgatgggcactgggttgattctgtctttgctattgtgaatagtgctggggtaaaaatacaagtgcaggtatgcttttgggagaacaattcattttcctgtgggtatatactcagtaatgggattgctgagtcaactggtaattctgtttctagttctttgagagatctccaaatggctttctacaggggctgaactaatttgcactccagccaccagtgtgtaagtgttctgttttctctgcaatcttgtcaacatccatgattttctgactttttattactagccattctgactggtgtgagatcctatctcgttgtggttttgatttgcatctctcgacatttagtgattttgagcgttttttcatatgtttgtttgccacttatatgtctccttttcagaactgtctgttcatgtccttggcccactttgtaatggggttatttgtttttttcttattgagttgtttaagttccttatggattctggatattagacctttatcacatgcatactttgcaaatattttctcccattctataggttgtctgtttactgtgttgatagtttcttttgctctgcagaagctctgtagtttaattaggtctcaattgtcaattttcggttttgttgcatttgcttttgaagatttatcataaatcccttgctgaggccaaggtctagaagggtttttcctaggttttcttctaggtagagcaaaactttaaatacacatttaaaaaatatattttcttcagaaaccaggatgcaaaagaaatttccaatattcctatattttattaataaatgtatgaatttgagcaatgaaagaaaacatctcaattcttttcaaaaaacacattttccttctttttggtgttgtaataatatgctcccaagtgacatggaagtgactacttctactggtcatcagtggtaggatgggagggtaccaaatctggcagcaaagaagtttacaaatcatattgtaaaaaataagcaattgtgagaaacggttattgcaataagttccagaaatcattatggacttccataaatcattaaactccatagcaaacttaagtacattttagttggattggattctggttcagaaagctaaaaaggacattgctgggacaattggcaaagttctaaaaagaactaaaaaaagatgatagaactgtaccaacatccgtggaacagaatagagaacccagtaataaggccacacacctacaacaatctgatcttcaacaaacctgacaataacacacagtagggaaagaatttatttaataaatggtgctgcgataactggctagccatatgcagaagattgaaattggaccccttcctttcaccatatacaaaaattaactcaaaatggattagagacttcaatgtaaaacccaaaactgtaaaaaccctggaggaaaacctaggcaataccattttggacatagaaacaggaaaatattttatgacgaagacatcaaaagcaattgcaacaaaagcaacacttgacaaatgtgagctaattaaactaaaggccttctgtacagcaaaggaaactgtcaacagaatgaacagacaacctacagaatgggagaaaatgtttgcaaactatgcatctgacaaaggtctaataatcagcatctataaggaacttaaacaaatttacaagggaaaaacaaccccattacaaattaggcaaaggacatgaacagacacttttcagaagaagacatacatctgaacaacaatcatatgaataaaagctcaacaatactgatcattagagacatacaaatgaaaaccacaatgagataccatctcacaccagtcagaatggatattattaaaaagtcaaaatacaacagatgctggcaagattgtggagaaatacactgttgatgagagtgtagatagtgtagattattttaaccattgtggaagatggtgtggtgattcctcaaagacctaaaaacagaaataccatttgacccagcaatcccattactgggcatatactcaaaggaatataaatcattcttttatgaagacacatgcacacatatgttcattacactactattcataatagcaaacacatggaatcaacctaaatgcccatcagtggtagactcgataaagaaaatgtggtatatatataccatggaatactatgcagccataaaaagaatgggaccatgttctttgtaggacagggatggaggtggaagccattatccttagcaaactaacacaggaacagaaaaccaaatgccacaggttctgacttctaagtgggagctaaatgataagaacacatggatacatgggggaacaacacacacaggggcttattggagggtggagggtgggaggagggaaaggatcaggaaaaataatgaatggatactaggcttaatatctggatgatgaaataatctgtacaacaaacccctctgacataggtttacctatataacaaacctgcacatgtacccctgaacttaaatgttaaatgaaaacataataaaaataaaacagggatgtatacacacacacacacacacacacacacacacacacacatgcacacatatatatatataaaatgatgtgcatatataatggtcatatatatatgaggtaaaatattaacaattgagaaatctggatgaaggagatatggagatataggagttctttatactggctttgcaaattttttaaaagtttgaaagtattttaaaaataaattatgtaaagggatcataccatatgtagttacgcattaattgtcacaatgtttctctgattatttacatcatggcatttagctttacagttaaactatttgtacaaactcttggtcatataacattctgagaagacaattaattttggctttgaataaataaaacactagaagaattgttttctccttaccactttgtgtcttatggccattaacaaaaaatactgatagattgactttactttttatgactcttttagttttctagttctagaacgtatattacaattttaagatctaattaaagcactttatcgcatacagtattgtctctttttttcactgttgaacaacatatttttaattttgaaattcttcttttccattactaatggtaagaattagatgattgttggttttacaaaaatcacaatagatggaaaagaaaacactgtattttctcacatgtgcatcaaataccagggttttggctcataaatcagaagagcacaaaaagatacaactggagtccttcctagttccactgttacagccaaaatgctgacattcaggcatatttccaagacccacgtttcggtaagcccttatgtgcttcgagtgggctgaaaagaatgtgaaataatttcacatggcaccttttacagaaggctgtgtgaggaacacaacattctctttgaaagagaaagtcatctttgtaataataaccattggttgctttcttttttttaggcatgtaataacattagaagatttactttggaacttgtttggaccattatcaacacgttagttttggtgacaaaatttgcatttactactgtagagctgtaatacctgaaagatgcaccatcctgacttgggactaagagcagctctcaacctcttttattcccctcaaaaccaacaccagtgcacaagtacctctgatattagataaaataatgaagctcacagtaattataatgcctattattttatcagcatctaccacgttctaagtgccttacattcttgatccaaactaatcttcaaaaccatccttaaagaaaaaaacttttcatgttacaaataaggaaactgaggcccaaaagagctaagcagcttgcctagcatcaaaatagtattgatggacaagaaattcacctgttctatgtcactctggaacctgtgcttttttcacaaaacctgtctgaagttagaggggtaacaaatggttactagcatggctaagagaagttacatgtggacagcactcggatttcaactagttggcagattatgcttgcttcagtggggtgggaaaactgacaaatcctctgacattagggcaaagaactttgttagatgtcatcattattacaggtgactctgatgccattttattaaaggctgtatcttctttctgtttctatctacaatgcttagtggtacacaacgcatgacaggtgcctaggaagtctttgttaaataaaagagtgaatgaaatatgtaatagagtaacttattgaatggcagcttaatggccttagtgaccagaattaactggtcaagagttaggggggtattgccagttaagatttcaagaacagttttttttttttaactgcagtatgggtgaagaagggtgaagtagaaaagtttacaaagaattaagaactgattttgaaaaatgataagccctgacctaatgaattacattttaaagcattctttagttatggaataggaatatataaaagcagtgattatcttcttttttcttcactgtttccaattggttgtattttttttttctctcctcagctggaaatgcctaggttccacagttacaatgtctgctgattttatattacttaagtcttgtagttttttcctttaattgtgaagccattcttacctaagttcaatcatattggaataattttcatactcctaaattagtatattagaattttttttcctcaacctatctttactagcataattaacttacatatatccatcctttagatttcgttttcttccacagtcactggaaggtggttcaaattctccagggcacttttatcttcccattcaaaacatgtccatttacattctccctggattgtgaagcattatgcactccatatgaatgtggaggcaccattttcttctgcctcctagtaataaactgctgtttttcatcagttttaatatttactttcaacagaaactgtcaagattgccattatactatttgctaataggaggcctgccctttttaaatatgctttttaaaaaaacccagattccttttctacagggccgaaattaaagcaggttatgaccatggcccgtgaggcatggttttatgactctgctgaaatctcagcctcctgctcctccccttgagggataagaagcaaatatgctttggtaagattgatgaagcaatgatatccccaagtatattcctattaagttccggtttcacagaacttacaacagggtaaaacccccaaataataactttctccagatatttatgatacatagtttataaattattacctagcaaaaatactcttgtatacaaataatcagtattttcttcaaagagagcatatttctggattaatttctgaaaacattcttagcagggaagtttccagaaagttggggactttctgtatcccttgacttttgatttctgtgcgacagagctcagtagtaaattgtccttaccatccctcatttaccttctaaggtactgagtcattgtagaatatttttaacatcttgtgtttccagacattgcttcatttgcaaacttaagaacatttaaatatttaagagtatttattttttaaaacagagatttcatacaagtgacacagctaagtccaaacactgtattatttatgtccccagcgcttgactttttgagtttcttttcttaatatttcagttctagagatttcatgtgatatactagataccaattactaaagtgttgttcagagagcagagggttaaaatgttttcttagtgaattctttaaaaactgtagctgtggaagcaggattgctcttgtttcatcctgacaggaatggtagatttaataggttccccagagctttttatcgcattataactctttctgtgatggtcagttttgggtccacattatgtgacctgactttcaacttgtttgaactgctgtcaggctgcagaggaactgaaggctactagatagtcctgtagttttccagttgggaaaacaacaatcctgcctgaaaacttctgacaagatccaatactgttcttcttatagcaaaactgagtcagcctgatacctggaaaaatctttacctgctcaaagtaaagcagtgtggccagaatgccttatcgtaatgtaaatctgtgttgctttgctctataataacagcttgtctatctcttgtgatcattcattccctgaggttgaaactattatcatgtcagcagagctcccttctcagttagcttgcattgctagccagcactcctgtataaatcttgatgtctcctaaatgttctccctagatccagtgtgtggtatttaaattaaggaagctcagacatgtcttgaaaggaactgaagtattgcatttagtcttgccaatccactgattaaaattcttgccaagtgttacattatgcacagcttccttattttggctgtaaatttcattgcatatttttctaggatgagaaagtttgtactttttatttcataagcccacataataaacacagctttcttcaaaaccgtttgaggtgttggatgcgtgtgctgtgttaaatatagggctcctttgtggaggaaagcacatgtggctcattttaacttcacacacaagcattttagacggggcaaaatggttctgctgggtaaaaagaaaatagacatttcgatgagctgcaggattatccaagccatagctttatcctctctgaaatctcttctatgcacttgaagaatgaacaaaactttctttatggacacagaagaacccactctcttctctcctatagccactgccactcattctgcccctgtattttaaatttttagtgggtgagtatgtgaatcgaaagctctcagagctggggggtggtggctcacacctatgatcctagcactttggaaggccaaggcaggcagatctcttgagttcaagaccagcctgggcaacatggcaagaccctgtatctacaaaaaatacaaatatttgctgggcatcatggtgccctcctatagtcctagctacttgctactcggggactgaggcaggaggatgacttgacctcaggagtttgaggctgcagtgagctatgattgcaccactacactttagcctgggcaacagagtgagaccctgtctcttaaaaaaaaaaaaggctctcacttttcactaaataaatgcttctctagcataaaactttgtgtagcgtcctttcagctaccattctgaagagaaaaccccaatgtcttagagagggaacaaatagatttagagggagattagcagaagccataaaatgcatactttggacccaatgactgggcctgcatttggaataaggggtagaaaactggataattcgctccatttacttctgtaaatgtatttttctttggtagcagccttgcaggagaagggcatctttgaaggtctggaggtggggctccactgacattcaaataacgcaggcctagggtacagggactgaaagctcactgcacttttgattcggattgggatcctcccataggttccattggcaaatgactactttcttaacaaaaagaaatagttctataattaatttttcttaaggaaaatcatatctcaacctattaatttagaaatattttaaatgagtacatggggatacaaatttagttatacaaatcacatgtgacactgttcatgctgttcgtatttcagtatagattaaaattttttaatgctaaaaagagcttttcttgctcttagagttttttttcatgcacatttccatgaaaatttagaagttatgagggcaaaatcttcatctatacacaaacacttttttttaaacaaaaaggagtaaaatttcatcaacattatgaactatgagccctattgaataattttttcctgtaaaaaacagaatcaagttatgaaatgaagaaaataattaggtctttgctaaaacttagtctttattaagcccaactttttcttaatcagaaaaagatgtcaaaaggaataattgtattgcttgacaaagtgatcaagatgttttctgctcctaagttatttcttcatgtgacaatcattccttaaagctcctcttaataaataatggaaagaaagaaagttgatgtttggattggggcaataaatgtcatctttatgtgtgtagtttggagaaacgggcttcttgtttgccatctcctctccagagttacagatacagtgtcattggtccttttaaaagtatggaaagcagagtgaatggcaaaaggtttgccaaaacagattatcttttgtatgcgtcaagattttatatttttgcaaatatacatacacagacaggcttttcaaaaccattttccttcagacatccaagtaaaagttcagagtgatttcttttttgctccttaatatttttaatcctttatcatcttacctaaagccatttagtatttcctggagcagatggggtataagccataaaatgacatatttacttctttgtaggaagaaaattaggagaagagattctataacacgattgaagtttaaaagctaaattccttgaggaaagattatctttctccatagatctcattctctgataaaacaaatgaggttgtctcagaggcacctgttaatattgacctacatcatccctagttctgaccttgtgtccccagccactgggaagtttttggtagaaaaggaactattaagttggttcgtttcttatttcttggaaagagaaaggtctccctccccttgcacttctgcttgatctggtctctgaaggagacttccacagaaacaagggcacaatctgtgccttgcaactacgcctatcatttcctctttacttaaggtcaaaatttccattactgcttagactctattaataatgggtttgaagattattttggggaattattccttcaaggaatatagtgttaggacctgcgccttgagaagggtctctgcctggatggaggaacgaggatgctcttgagaaagaactgaattgtgaattttttcttttcaagtaaatttcccagttgttttaaaaaaaggtatgttgccgagcttttgaggaactcttcagaataccagagatgtcttcaatttaataacatcttacagcaccgttttcaccagctagtatatcctttgcctgaaaatccctgtcatctacgatgatgaatttactcctcattcagactgtctctctgaaataccagaaaaatatgatcttcattctcctctctggaccctttagtagtacctaacatgagtaaattcagcctcattgttgatggaaatatcccttcctggtgaaaactgacagaatctaagcaatcttaaggtcccatggctaccagtctggcacattctaggtttttccagctgccatttcttctttagtggtgtggtcagttctcctctggccccttcagtgaactgtttggggttttacccactctggcattgtctttacaatgtttcgtcagatcagaatttcccagtaatttaacacttctgtaatgaccaaagagaaatttcttatccagaatgtcaaggaatatgtctcagataaatgagatgtatgcctacaacatttcaaaatggcatcaggcttcaagttacagaaacaccatccacatcctaggtagtgacttacacaaaacacaaagtcattttttaaagaaaacaactgttttctctcattgaatgagaagtagttcagggctaatgtgactccttcacagatgatgtcagagattgagacacctcccaactgttctttctaccacaccatagtgtagtcagcacgcccatgttgactagatggctgctgaagtcttacccccatgtggttagtcttaggcaggaaggtggatgagtaggaaatcaataataataaataataaataaataacaaagatctgctatggaagtaagccctctgtaataagcttgcctggaagccccacctaatggcatccacctccatctaaattggtcactcatctctttttcatctttgaaagagatgctgataaatgtacattctaaattgggcatatagcctgcccactaatatagggattctgttaccagggaaaatgagaattgatagtgggtaggcaaccaccaatctatgtcataatgacattttctttgatttagaatttctttttaaattgggatcatgcgtatgtggaagaaaatgcatgaactaggtcttaaaatattttgtttactatgaatttagcatctgaaaaatacatctttaacatactctgggcaggattttaatgagcttgacttttttgctctcagacctaatgatgagatataggtcattgtttcatatttttccaagagattttaagggtctactgtaaacatttatgagaaacattttttttctcatttgctatttcaagttcagaaagaggaatgaaagtcactgtttcttgggtatctgcatattatttagatcttagagtctaggagagagaagcatctcttggtttttaaagatcagtccctacgtttttggatttgagatgaagaatgctagtgtgtgatctgtaactaaaaactgctccagtttcctgatgtgtaaatatttattctattatacttatcatcttctcctaggatcacggcccaaatctcatcttcaaattgaccaacaagatgaggaggttcataacaagttattttttaagtcagcccaaggcaggctcaaataaattaaccaaattcctcacatctgtgaagcttcaagatgtggatctccttgtcattgcattgtattttcttagagatgtttcttctgctccctaaaggaaacactgatgctattcagtacctgacacatgaatctttcatgcaggctataggtgacctctaatggaatccactttttacctgattacttcagctatattgtttttcctccccaaggggttaggacagctatttaaccttattgttttgtgtcttcctttgagagtggcttcttgctttgtatcccttctgatgaggatgatgatgatgatgaatatctgtgtaacaaaccacttccaaagtttagtgacttaaaacaacagctatttaattattgattctatgggttcactgtaaagctggacagttctttttctgttatctggcctcactcatatgtctggtcagttgccaggaaagctgaatgctggctagtctaagttggcctccgctgagatggcttaatcctgttccatataatctctcatccttcagctagctgatctggactagttcacatgggagctaagcagagttctaagagagtgagcagaaatgtgaaaggcctcttgagacttaggacgagtactggcacagagtcacttttgcctcattctattgaccaaagcaagtcatgagattagcctagattcaagtggtagggaaacagattgtatctcttgatggcaggagctgcagagtcatatggccaagggcatggatacaaagaaagaagtaattgctgcaacctttatgaaaggtctaccacattaagattcttcgagcacttattcaggcactgtatgagctaagcactgtacatgttatctcattcaattctcataagaactctacaaggttgatactaatattatacccattacatagatgcaaaaattctaagcgacagagactggcattttgattttaaagcccttttaattaccagatctgtggactccaaatgttcttgattgtatagttctctcagtacaaatattttgaacatgtacttatatgtatgtgtatgtttgcttataaattacatacaagtactactgtcatctatatattaaatattaataaacttgaacttcattcttatctttttagataaaaattataaatatcaactaaagtttcagtgcattttttcatcctttatatgaatgtcttgtagcctcactttggagaccatgcatcaagcggctccttatgcccaagatatttcatgattcccatgtatagcgttaagtgaaacactgtttaattgaaatcctacttgtcattgagttcagttccagttccagttaatattgcttgctttcaatgcagacttttaagggtggggactcttcctttttggatatttgattaggacttgcggaggagcgtgagagcaaggctttaattaaatttagagaggctcttttgatttatgagagtcaggactcatggtttcatgtgtccagtgaatactcagatcacttaacacagggcccaattgctcatcactttctggagctgtgtcaataaaacaagataacgtggaggaatgcttctcaaagttctcagttggcagtgtgtgtctctgttatctgcagagattacgaaatgcagactctgggtttccatggctggagagactgattttacagatttgaggctgggtatgggaatctgcatttttactaggctcgcttggtgacattgaccacaattatagggccataaaatctgaattcatatctgccacttaggtggatgaccttagataagtaatctattcttgaacttgttgaatttcttcaactataaaatggaaaaggtggctgggcacagtggctcacacctgtaatcccagcactttgggaggctgaagcaggtggatcacttgaggtgaggagttcgacactagcctgaccaacatggtaaaaccccatctttactaaaaaaacaaaaaattagctgggtgtggtggtgggcgcctgtaatctcagctactcgggaggctgaggcaggagaattgcttgaacctgggaggtggaggttgcagtgagccaagatcgtgccactgcactccagcctgggcaacaagagtgaaactccatctcaaaaaaaaaaaaaaaaaaaggaaaaggtaataaagctcaagaccaccttgcaaaatattttgcaaattaaatttgtgataattttgtcaaagtgctttataaaatgtaatacattaatatgtgacccattccctaaaatgttgtcaatctattaaaagatgtattctccatactaaggtattcggtatattgtaaattacttttaatttcaatgaaaacgtgattctgagcttctctgccctattcatttgggtcccaaggaaagagactatggtttatatttcctttcttctctgcatgaatggaggtagaagacagtagggatttataacagactttaagttcaggcaaacatgggctctgaccccagcttctacattatcttgcagtgattacttaacttccacctgtttatttattaagtagtgatcctaatgaattcttcctttcaaaatttttatcatgattttatcatgattaaatgagatatagccaaaatttattgcatacttgctgcgtgccagacattattcaaagtgcttgtcagtttactcacgaaaatcctataattttgagtggaggtcctatgagggatcccattttaaagatgagaaaatcaagaaaaagagatttaaatggtggcactaggattcaaatctctgctgtctgacaccttaaccatcctctttctacttcgtaacactacctctaaaaagtgaaagctttcaagtcacttagcacaccagtgggcacacagcacatcttcaaaatatgtgacattattattgttgttgttaatattattatttgatttccccacagcttcatgcagaatgctttgtgcaaggtagttgtttaacaaatttatggtaattcgatttttaaagaaccctgttgtatcctcttgggcttctgagagatacatattcaatgagcgaagcctcttactttttaggctaatatgatttatgcagctgcttttagattaagttaccatcttttatttacaaaaaaagattaaataaatatgtgaaaatccaagaactccaaaatctccctgtgaaaatccaagaattccaaaatttcccttgctaaaaactgtttagaaaatcatctttgtaagacaagaaggagacaaagaccaaacctacttttgattggtgtacctgaaagtgatggggagaatagaaccaagttggaaagcactcttcaggatattatccaggagaacttccccaaactagaaagacaggccaacattcaaattcaggaaatacagggaacaccacaaagatactccttgagaagagcaaccacaagacacataatcgtcagattcgccaaggttgaaatgaaggaaaaaatattaaatgcagccagagagaaaggtcaggttacccacaaagggaagcccatcagactaacagcagatctctctgaagaaaccctacaagccagaagagagtgggggccgatattcaacattcttatagaaaagaattttcaacccagagtttcatatccagccaaactaagcttcataagtgaaggagaaataaaatcctttacagacaagcggaggctgagagattttgtcaccaccaggcctgcgttacaagagctcctgaaggaagcactaaatatggaaaggaaaaatcggtaccagccactgcaaaaacataccaaattgtaaagaccatcaacactatgaagaaactgcatcaacaaatgggcaaaataaccagctagcatcataatgacaggatcaaattcacacataacaatattaaccttaaatataaacaggctaaatgccccaattaaaagacacaggcaaattggatagagtcaagaccctttggtgtgctgtgttcaggagacccatctcatgtgcaaagacacacataggctcaaaataaagggatggaggaagatttaccaaacaaatggaaagccaaaaaaaagcaagggttgcaatcctagtctctgataaagcagactttaaaccaacaaagattaaaaaaaagacaaaggcattacataatggtaaagggatcaatgcaacaagaagagctaactatcctaaatatatatgcacccaatacaggtgtgccaaggttcataaagcaagttcttagagacctacaaagagacttagactcccacacaacaatagtgggagactttaacaccccactgtcaatattagacagatcaatgagacagaaaattaacaaggatattcaggacttgaactcagctgtggaccaaacggacctaatagacatctacagaactctccactccaaatcaacagaatatacattcttttcagcaccacatcatgcttattctaacatacatccacaacacacttattccacataatttagaagtaaaatactcctcagcaaatgcaaaagaacggaaatcataacaaactgtctctcagaccacagtgcaatcaaattagaactcaggattaagaaactcactcaaaaccgcacaactacatggaaactgaacaagctgttcctgaatgactactgggtaaataacgaaattaaggcagaaataaataaattctttgaaaccaatgagaacaaagacacaacataccagaatctctgagacacagctaaagcagtgtttagagggaaatttatagcactaaatgcccacaggagaaagtgtgaaagatctaaaatcgacaccctaacatcacaaataaaagtactagagaagtaagagcaaacaaattcaaaagctagcagaagacaagaattaactaacatcagagcagaactgaaggagatagagtcatgaaaaactcttcaaaaaatcaatgaattcaggagctggatttttgaagagattaacaaaatagatagaccactagccagactaataaagaagaaaagagagaagaatcaaatagatacaataaaaaacgataaaggggatatcaccactgatcccatagaaataaaaactaccacagggccaatttctaaaataactggatttcactaaatggtgcatttagtgtttttcaaaatctgtatttagaactttgtcttggttctcttttatttttattttctgatagctctacattcattactgtacagtacctgatacgtttctgctcaatgctttgcagcttgttttttctcttttcaggatcaacttgttcatttgcttataaaatgatgagctttacctgaggaatgccagagaggcagattggactctctggggcaaaataatcttaagttaaaaaaaaattgaggtgttttcatgtcctatttcttttgcctttatttaagctatctaaacagtggaataagactattctataataacatcttcaaactctaagctccaaggtaatatgaacaaaagtgacaacaattcccctcaagcataactgaaacttatctttctatcccgctctcagacagtggaattctttaggctatagtctaaggaaagctaaccaagatagcctaattaataggctgaagtcctctgaatttagcctttgctagataattggagaaaatatgtcagggagtcaaaatccttgccttagttaaccatctgcctgcaagcattttggccttcttatcagggtggtaaatgacaggtatgtcagtacagcagaaagcctagcctttagaaggagctgcagctagactcccctcagtcctgacgaagagcagccctgtgagtgacctcagtgttcaccccaatactagctgaccttaccacaggcagtctttaataagtctctgttttaatcttctgttagtctggtttcagtcactaagtaggaggaacagctatttcaatgagtaggagagcttggctttgggtactcaccgagtcttcagactccagcatgattaaggactctgagacatacctagggcaatgagcttggccaatacattcattctagtaataaaagctgatttttttgcacaagtttaaaaaaaacagtgatccagtggaacaaaaattgccatcatgatatttacaacagaaatgaatgtatttgttaaggcaaactggtgttgcaaacatccccaaattgtagtggttctacataataaaggtttatcacctgattcacagtctagtatgggaagtgggagtggagctgtgttccacacagtcatttagggactcagacactttttgtctggttgctgcaccatctcctgggtcattggtgtcctgcctgagcccctgcattcagcctgcagacaatggaaggtcatatggaggaccttgtgcaggatttttatggactggatgtagaaatagttatatcacttttactcatactctttaaacaggactcagtctcacaaccccctaaaattacaagagtgtttgggaagtactgtcttgctcatgtagcccaggaataaaaccaaatgggctttggtgaacaaacagcagactagccacagtggtcttgaaaaattctatatattgtggttctatttactgatggagcttagttgtcttttttcctataatatatatatttttggtatgataagaagcatagacagtcctattgctctctagaagattgtattccacttttttccctcttttagatttctgatcttgggttctattcttttcttctttagtggtgattaggtttagatgatctctgtcagcccgagtacaaactatgggtctcctccccatctgcctccccagggtagatgtgagaagtgctactgtgttgtattccacatcttgccactattcagcctgctgtctttttattctgaccctttgtgaagtcaaaaggcaaggttttctgcagattgaactagacctgagtggagaagggggtgaactttcagattcaatgaattataacacttctaatatagaacctcatcaccagatttgtgatgacaacactagctgtgtatttgactttactttttactttctaattccttggatttgagtaacctaaccatttcctcagtattatcagaaaaaaaaaaacaacacattacttttcctcccacatttaattgaatcaaaatcaactgtattaagcagttacagagtcatttattaagataggtggggatatacaaaagaataagccacctcctgcttcttcaagaaactgagagtaaggtgggaaacagacttttagcatataagcattctgctgtgtttatgtaatagctataaaacagtttataaatatgacaataagggtgcaaaccagaatatgatgggaacataaagagacatttattttgtccagttgtaaatggtttcttaaaagagaaaacatttgaaatagaaattgaaaaatgggaaagacctcgctaggcagaaaaggagagggaatagaaagcctgggtagagggtaccgtgcaaaggacgtcatggtgcctttagagaacagcaaggtcatgggtgtggccaaatcagaggatgtgaagggagaaagtgtaggaggatatgagagttgggaggataagttggaacaacatttatgaagggtctaaacaccttaatttggaattagtgttttacaatgtaagatatgaagaacaacaaacatgactttaatagagaagcagtaagatcagactcacattttataaaaataagtctagcaacagaattgacaatagattagagaattttaaactcttatattgagtttgtacatataggggtattacctttttgtctttcaaagacttgcttttgagcatagaattgatacaattgatattaccattgcccttttctcccacacgctttttttcaagtgccacaaatatagctctgaaataataggagatcatattttaattgaaagtgtggtatgtagttccattgttctataatgaaagactaacatgtatcagatgaccttcataccaatagtaactaggaattcttgacaaaatataagcaacaacagaaattgtttattggcactagcaagtaacttaaaataggctgaaataagagagattctatttgtgacataaggaaccacactgagtgagagccacatttaagagatcatgtgacttggaccctgagggtcctacttaactcatatggtaagtggctgagagggctgaaatagaaagcaatagttattcacatgggaaaccacaggactgaattcaggattgtcagaataggaattaaggaggagatgccagaaaggagagagtcacagatgaaggagcccaaaatctacaaataaatccctcttgaatccttggttgagtctatgcatatgcagagaaagactctaagaagcctaggaagaaaatgaaagctagaaggtgtaaataactgagaaaataattcagcagcttcttaactgtatgtctatagaatttggaattttagttctccccaagttagagggggcttggctaacatcttgggttttccgctgaaactccagaagggctatgcggtaggagtaaagactacatcctggcattaagggatttatcatagaacttaagaaaaaattgaaatagacccaccttaacgaaacgtccatattacttggcagtattttacctgcctgctagaacaaacttctaagataatagaatcttctaagataatagaagataatagaatctaaagcctctaccatatattatacacaagtttcaatatgccatcagtaatttactagacatgcaaagaaataagaaaatgtattccagagtcaaatgaaaaatgagtcaatacagacagacccatagctgacctagataatggaattggcacatagggacattaaaataactatgtcacatctgttaaggaatttacatgactagataaaatagaatggatgaggagatgggaaatttcaggagtcataggaaaacagtaagaagaagaaccaaatggaaatttcaagaatgaaaaaaatgaaatatttgaaactttaaaaagtgaaatggaattaataacagatttatcacaactcagtaataaaaagacaacaaaaattagcaaaagacatgagcagatacttccaaaaataagatatatgaatggccagtatacatttggcaagacatctagcattattaattatcagggaaatgtgcattgaatactcctttatagtcattagaattaccaacattaaaaaggctgacgacaacaagggactgccaaaatttgaactctcttacattgctggggttatgtgtaacatggtaatcactggggaaaactgttatgttagttctttataaaataaatatgtacttacctagtaatttcactcaatgatatttgtccaatggaaatgaaaacgtatagctacaagatggtttatacaagtatgcagattgattcataatagctaaaaactagaaacagtctaatgtctattcacagatgaatggataaagaaattacagcatattcaacaatggagtattacaaataaaaaggaagaagtctaaatatatacaacacaggtgaatctcagaaatatttaatatgtggagtaaaagaaggcagtctctctatctttatataaagtttgaagttatatagcaggtaaaacagttctggtgatcaaagtcagaacaggaactccctctgggtgaggggaggggaaattgaatggaaagggcacaaggtagctttttgggttcagggaaaggttttgtatctttattagcatcatggttacataaatgcacacagttgttaaaagttgtcaaaactgcacacttaaaatctgtacatttgattgtgtgtacattataagtcataaatagaatggatgggaatttaaaagtaatgtaatagagtgcttcgatatgccacatgcaggaattgagaagacagtgattaataatggttaagagcatggttgcaatatcagataaatctggggttttgaatcacgtcgtgagtactttgtgaatgtaagcaagttactaacctaagatcctaggaaatggagatgataaaattaatatttaccttataaggttgtccttagtgcagtgcccagcacattgatgcatttggtacatttaagctgtagttattattattaaatagctcttcagctagactttcactgcccgagtgcagtcaggaatactgggataaccatgaaaattttgagaattagatatctgcaaactgcattaaggagcaatctaaataatgcaggtaatatttgacagcatatgattaagtatactaggaaatcctattttcattatctatttgaaagcaactaattacctctttgccaagaaaacgtttactttaaaatacttttcttaaagctcttgtaaaaaattttcatatatagagaaattaggacttaatttttcccttatacagtaatctcaccctctgtttcccatctcataataatatcaccaactgctgcatatattttcagtacatatatatatgtgtgtgtgctgaatatatatatacacattacatatatatattacattacatatatatatccatatatatgtatattcagtacatatatatatgtacgtgtgtgtatataatgttgtaaacaaaatggtaaccatactatatgtacttttctaaacctggcattttcactgagaaatcttttcatttgaaggactctgtttacctatagctggtctattcattttaagtggtgtattacagtctatggcattgatgggcttttatttatttaaccagctcctgttgatggacatctgagtagatccaagttttcactattgtaaacaactgtgacatccttgtatacgtattttttgcacttgtgttaataatttcatgtaataaatttaaaaagtaaaaatgctaattgaaagaattttaacaaaatatattaatgtttctttgtaagagaaaaaactttatttttatttatttattttttttgagacggagtttcactcttgttgcccaggctggagtgcaatggcacgatcttggctcactgcaacctccgcctcctaggttcaagcaattctcctgcctcagcctcctgagtagccaggattacaggcatgcaccaccacacccggctaattttgtatttttagtagagacggggtttctccatgttggtcaggctggtctcgaacatctgacctcaggtgatccgcccgcctcagcctcctaaagtgctgggattacaggcatgagccactgtgcccggcctttatttcttctttttaaataaagaagaattatttcaaaatttacacaaaatttgatttagagtacttaagataactaccaccaaagggacacataacactgtactagacactatgctgaatgccttccatgcacaaaattattcaaattttatgcacaactttgtaactgtgtgagatactaccattattgacaaggacttgtaagaaaaccagtgcttggagcatgccatatctggtaaatgtttaagtctggatttcaacctagattttgcaaaacatgcagtgtagcgtagtctggagtgaatttatttttttgtgagtgtctttgaggttgaggatcattgtcaaactttggtgatatgcaagtggtgaagtaataaagcccagataatgttgtttccctggaacacttgtgaggccaaaagtgatgcctccctgccatgcagtggcagcagaagtcaacctggacattagacaagttatacttcccttagtgccaatagcctgtcccatatccagcttcgtcttaaataataataatgataatgataataaagatcaaggatcaattacatggtgttatggactgtggagaggagaagtcttcagacctctaatattctatctattttcacattccagttactactactctctcttttcctttattttataatcttgctttttttttctatccaaggggcccattcaataataactaaagccccaaatcctcaatttcctaatttatgtgtctgtgatcttttagtcttctacccttctacctgtgcactcacacacagagaactttaatttccagcgacatcaaatttgtgctctcaaaaggtaatttgtgatgcctggatgtcaaaggcgcccagatgtaaagctagagagctgatgagacctgaggctggtcacgggcacaaagcctgcccttctggcagagtcggagcagcactgaagttctgcttcaggccgtgccaagtgagagtaaggggtggtcttatgggtgttaagcaagacctaatctacccttgcgcagcacccagtcagacaccctgcagaaacacaatcatgtgtgtgtcattctgttgtggggagaagttgctcaaaggtttggttttgattttggtagctttaattctactccttcagttttgaggtgagcacaaatgtttcagagtacctttctaggtttcttactgacttttttcttctctaacctgtggtgtgttagaggcaacatgtaccagctcgggaaagagagacaattgtgagcatttcttctcaaccctgtgttcagtgacatcaagttaatagcttaaaattggatatggggaaaggaattataccactgaaatggaaaaatgctacatatcaaggattctcccaccccagagaacctgttgtttaactagcacacaacttctataacccttctacttctgttcaccacataacctcaccccccccccccggcccccgccaacacacacacaaacaagctagtgtttgaaacattggacaccctgggttttcttccacgggctatggttatttacaggaagaacaaattgagttctcttcctcttcccatcttgagctttatatttatttccaaatgccaaatataagctaactttcttctttctcccttagtggatggctgtattcatagagcagccggcccctgtttgctagctgaatgtcgtaacctgaatggctgtgatactggacatgcaaaaatcacatgtggctatgaccttcctgcaaaatgtgagtacaactgaatactgtttcaaaaccagatgagacatcttaacttgttttactccagtgtataactggaaaaggaaatggcagtggtggtatttaattaaatgtgcttgagttcagattttgtacatggtaataaaaacgtgctttccaagtatgtctccaaatatatacatatatataaaatatacatatactgtgtatattatatatatatatgtatatacacacatatgatgtttaactattcaggtctttgacagagtgtctctgaaagggaaataaaaacatgagcaaaatatacattatagcatttaagtgccacagagtgacagctcctggaaatgatgccaatttcttattccttgttcaggtttcttgattgtggatgtgtttagagcaaaggagatcaaagtgatgtattgtttttccagctgccatgtaaaggctgattggcaattacagccaaggcatctgtcacactttgctttcaggaaaagccaacgaaatctggttgtcagtgtgagaatgtgtttgctctttgaatgcggaatggtcaaaatttccgttatattttaatagagagaagtattgcatttgattgaccttattgcttagtgattcaaccaactgggtggcatggtatgggataaaatacttagagagaagctggtcagtgtcatagcttttttatcctgtaatcttcagggcctgaggttggaggtagagggtttcattgcatcattaaggtgtgtattgacctggaaattgagacaccaatttgttgattatcacattcgtccacttcttatgatactgctgagatctgtggaatacattttatgtaaaagtgaagctggttttgatttttgttttagcagtggagaaaatatgaatgaaaatttataatacaacctataggatactatgggttatatatagacaggttgtcataacagtgaatttcttgtggatgtgtgtgaatggagaatagcgtgttatattttaaagattactgtaaaggtatgtttaaatttgaggacttgtagcaaatagtaatatattaaaacagtatttttctttatcaatataatattgcatcctatattgttcataatggtttcagtgaaagtactttcatgtactgcatagcgatgctttggtcaatgatggaacacatatatggcggtggtcctataagattataatacagattgagtattccttacccaaaatgcttgagaccagacatgatttggatttcagatctttttttcagattttgaaatatttgcatatacaaaatgaagtaatttggagatggggcccaagtctaagcacaaaattcatttatgttttatatgcaccttatacacataacatgagtgtgatattatacaatattttaaataattttgtgcatgaaacaaagttttgattgtgttttgactggcctgtcacatgagataaagtgtggaattttccacttgtggcatcatgttggcacacaaagttttagattttggagcattttgaatttcaaaacttggattagggattcaacctgtactatatttttactgtacgttttctatgtttagctatgtttacatacttaccattgtgttacaattatttgcagtattcagtacagtaacatgctgtacaggtttgtagcctgggagcaataggctatagcctatagtctaggtgtgtagtaggctataccatctcggtttgtgtaagtataccctatgattacataacgatgaaatcacctaaggagtcacttctcagaccatattcctgatggtaagtgaagcatgattgtatatcaactatatatgctgtttaatttttcctttaatgatttttcatttatttttctttgttagtatctttacctagtgtgaaatagtcaaatcatgtgccaaatggctcttcactactacttggaatatgtacttgtgtcaaacaaaccctttgtgtagaatggtgtttagagcagttctctttgtaactcagaggtcatgatctgggtattaacggtgatttctctctccagaatcatatagtgctatttttacaaatattggttcttttgctttctaataccattctaccttcataatttacctaacttacactgccctgagaacaagcaaggttgttgactgctacaataatagcaagattattgactgttttcagacttgtatctgtccttaaaccaagtaatattcccagtcccctattgattcactgttttcttttttatgtattaaaatacaaatcaaatttctccaaatctgaactttctaaagaacagtatactcagaatcattaaatacgcccaaataaaatggtggctgtagtgtatgggttcacactgtgataattttttaaatgtgcttgtatctgtttgacatccctttgaataagttattcagtttcctttgaatacaattcatcttattttagggttattgaagacttgcacaataccaggcactgaggaacaaagatcagtgagtcaataccagtgcttgaagaattccaatgcttgagtcataacttcgaactgaagtgtggctttcatgggcatcctggggcaaatggatcttttgggacaatgaagctagaaatgaccagtcaatcaatgggactagctacagaatccatgagagctgagatcctgagagccgacagatactcaagtcactgcatgcagcccacagggcatgtttagtaaaaactcatccaatagaatagaaattaccagacaggcattgcagtgccacctcataaaagtcataaacatggaatatttgtgactaggtcttgcttcttcctatatatttaaaaggttaatgatttatattaaaagcataaaggaaagcaaggaaagcaatatgaaaatggtaataatagcttacatttttatgccactttataatatttcacagtactttcacaagcccttatatttaaaattatgtttgataaacattgtgtgtgttcattttccctttccctatccctgagagatgtttttctttctcatcaatttggttcatccatttcagagtcattaacaatccacagatgtgcttttgtagtgagaatgaaaagggagctcgttacatactgtttgggtcatttttcctctccatatttaataattccatgacagtttgacagcagagactagttgctatctgtcctctgagacagcgggtttatcattataggggtactaaagccagtcatccagccacaagtgataatatcttcatgcatcagcaatttgtttggaaaatgctattgtctgggttacagacaaacttcatagttttgaactggtttttgcctcttttatgcttgctaaattaatctattcataaatggttgtatttgaattaattatacttgtattctgtgttctgtgactcatcataattagtagaatgataagccccagatatttagtttacttttcactgcttggatgttttgaatgatttctttttgacattaagaatatccaatcattcttttcaaaagaaatcttaagggtagaaagaatattggtcaatatttcattgaaggctattgctaaggaaatgacttagaaagtagatggaggattgtttatgtaattggatcttttgggaatcttctctacaatattagatatttttgaattcataatgcaatttaaatttttatagatttttagaagcttgttgacatatgggacatttctattcatgctatcatcattccgccaagtagtcagcttcacataggcaagatttgtctatctcagtcagttccaatgtcagtatcaatcatagtgtctcctaaatatgtgctgaattaatgtgaataaatgaaggatcagacgagtgaattatttcaagacttcttcacctgaaaaatagtttttaaaaacacttttgcctctacttctaatacttttccttccgcaattattctgcacatttctagtaaattaacattcttaaatccagagtccttaaaattgtctacaatgctctacatgatgtgacctttacttctctacatcatctccttctgtgcttcccccactcacacaggctgctttgtgtgaacctggtcctcaaagcctttgcactggcattccttctgctggatttctattcttctagatacctacatggcttgttccttacctacctcaaactcttgttcaaatgtaacatcaggtgtcaccctaaccaacctatttataattgcttcagtttttaaatttgtaattgcttacttgtaaagttaatcttcaaatagcattatatcatttacttatttcttttgtttcttatctgtttctatctaccagaatatgggcacagattcttctttcttcatttttctaatgtattgctatattcatatagcttaaaaaatgtgtgatatataataggggttcaaaagatatttgatgaatgaatgaataaaacgtaactctaatcctctcaaaatccgatagtggatttttccttaaacacagactcattagcctgattacctttggccttccactgaactacttacaaccttttgtatgatatgaattgctcacaatggtgtgtctatgcatggggtctgtatctgagctatctagaaagctctttctttgctcctttcacttgtcttccagactcagttcaaatatcacttctgccatgaaacaagtcttctcgcctcacctcagctaaaaatgccttcttttttcttcacactccagaatacttcatgttaacatactgagggcacttgtcacgtgctaccttttattgttggatatgcaaacttcccacttttataacagagtaccttgtatatcacaggtactagagaaatatctaacaaatgaattagttattgaaagtgtcaaacctggttgataattggtagtaggtggaatataaaggaaaaattatgctaatattcataagaaattatgaaatcagtgtcaattatccattgtgtttttaaaaaacatattttaacatatatatactacaaagtctcctgtctccaaaatttactcttaatggagtttctcctaaggagaaaaaaaaataaaaataaagaaaccatatcacccttatttgatggttttcagcatagctcacatgtctattttatttctttagaatgcttctctcttaggcttcagggctgaatagtcatcaaggataaatggaaaaatattaaacttgtgtaaatgaaatggtggaatctgtttcttttatttcttctatttaatctttggaaggcatcaaggggtaatattgactaactcaaggttttcattaatcatttgaagggaaactctaaggtgagagaccatagcataatatgtttgaatgagtggtatgaatcagaatacacattctattcccaggtgcaataataatcagatgatagtagcttaaaatgtactgttgataataattagtacttcttttctgccctttatcaagaaatcatagtactttgaaacagtagctcatcagtccttttgaaattcctatgaggaggtgacgtgacaagtaaagttttcttacaacacaaagagaaatacaggtacagggaaaataaatctgttgctcccattaacaaactaaatccatattagaggcatcgtggtggccaaggatccctgagctgggaaaggagtctctgttaggtgttagccaggcctgctgcctgtttttatagataaagctttattagaacacagttgtggccatttgtttacatattgtctatggctgctttcatgtggcagagttgagttgtagctacagggattttacggccacagaacctgaagtgttcactatccagcctctgtggaaaaagtttgccagcccctggtctgtggcaatctgcacttttatttttatttttttctccctgagtcagacggattccagctctgtcgcccaggctggagtgcaatggcgcgatcttggctcactgcaacctccgcctcctgggctcaagcgattctcctgcctcatcctcccgagtagctgggattacaggcatgcgccacaacacccagctaatttttgtatgtttactagagctggggtttcgccatgttggccaggctggtctcaaactcctgacctcaggtgatccactggcctcagcctcccaaagtgtgggattacaggtgtgaaccacagcacctggccaatcttccctttttataaagtaagaaaggtgagattcagagagactaaatattgaattttattaaatgaattactacttattcagatcaaagttgataaagttgagactaaaatacctaccctctattccttgggacatccttgcttctgttgcctcaagagaacattaccttgggaagatgatctgaaacctttcaaatctttcaaataataaggccaccttgaaaagaatgcctagaaaaatatggtgatttttcccaatagggccagatctgggaagtgagtaagtcgagtctctcaagggagagtcagtttaaaccaccagagtattaggaagcaaatctttgttccttgtttcctccagtggtgttagctgcaaaggagcctgcagtccacaggaaatgcagtttctagagcaggtaattcataagatggttctgagttagtcctttgcaaagggtgacctgatttcagccatcgtggactctcccagcaggtgtctgattgtgaaagcagtggagtggacatgctgctaggagtatgactctgccagcctttgatgaagacctgagggccctcatgagccccttccataatcaaatgacttatattacacaaagagaaaagccgcttttgaagatcataaaatcatcttcctttctgaagaggaagatgggattgttcctcctaaaatcaactcggattggctcattttctttaagtgcttaaggaattcaggttttatttgaatctatttctccataattgtcacccttttcatttacattaagcagtttcatacatttaatctccttagtgatcctcatgatgaatgtggaaataagaagggcagaaatattctaaaaaccagagcagtggttctcaaaacgtggttcctggagcagcagcatcacctgggaatttgtttgatacaaattctcaggccccaccccacacctactgattcagaaaccctgtggtttaacaagttctccaagtaactctattgcgtgctcaagtgtgagggccattgccctagagagtggtggaatccagtagcacccttgccttgagatttcttttggctttacaacacaggtatccatttgggtcacagattagggctttttttgaagagaactctgacacgttcttcttttcctttatagcattttccactagtgatgacatctgtgtttgtttatttgtttattacctgtctttttagacaaaataacattttaagaagggaaggtgtcctatgggtctcatttacccctgatatccttagcatctgacatagtacccagaacagagttggctcttgatacatatttactggaggacttaatgaaagcattgtttttatctcctcttgtctttgtcataatcatagctgccctgcaggaaaccgagcaagaagacactcaagagagaacaacatgattccaggaatctgcagagctagtactcctgctgcttttagcatctctgttatcccatcaccaaacatactgcctgctcaaaggctagcagtataagaaagcacaggggccaaactttgcttaatgtatccacatgccacatgtctgttctatgcttagcttctttcattttctcttattttgacccattgtgataacatagagtccacccccaaatggctttgtgatgaaataacttaatgattctaatactaaatgttgtcttttaaaaaatatctaccttttggaagcaactggtgtttacactgttgtattactggctgagtgtagaattaaacagctgtgttttgcattatttgccatcatagcaagcctttagaggacgctgtctatacctcctatttcctatgtgatcaataggaaataacagtgtaaatcaattctaggtaataatgtaaatgggctcttgaaggcaattcctgctgtgaaataagtagttagcagtgacactggcattaaccacagtgggggtaatcagcctttggatgtgtttaatcagagttatcagctaagattaaaaagagagccactgttgtacagggataatcattttcaggatttaaaagatgaatatttggaggtgttctcataaattaaagccatcagaatggctttgagtaatttaggatgccctgaggtcaggcacaagcaaacaggaaaggttaatctcagagctacggtagctgatgtgcagagatggcagaatacatttattgaaataagtagcaaatgctgagtaaaagtgtagattttttttctccctgtgttaagatgttccttgagctattacttacatatatgatttgattaaaaagtagtccacagtgaacacttcgtgaatgtattaactctccctgtaattaatcactaatcccaaagattaaatattaggccatgttatgacttgattagaggtgtttctacttgaaaatattgatgtaaccaagctctgtattatagaatgtaagattgattctgtgtcaagaacactaaatgtcatggtagaagatctgagatgcataaatgcagagtgttgtaattggtaaagtccttaacttctgagcctgaggttccttatacgtgattgtctaggagtgtgaagatctcactctggagagtctgttaagccatatacgcagaaccgcttcttaatactgtcagataagagagataaatggctctattattatttgtaaaatacatggcacacttgatttgcttgttcagcccatgttttattgagtacttactcacagctagagtgctcttctagagtgtagacgactatagtgaggaagacagcaggccccttgtcctctaagagcttaggtcctagcagagagaggatgctaatgaacaagtcacataaaagcaaagaacctcagataatggtaagggctatgagagaaaaaagatccccttaccagatgtatacagtaaggatagttcatacatttttgaaatgttctcccttgctacaaatattctatttcagttcttacatatttgtaactttagtctaatttttggagataacaaagggaatgctgcttctgatagagctgacaggaattttaattattacctatttgatctcagaattttacagataaagtaaccgaggcctaggaaaattacttaatttttcccaggtcatgtggtaagagacagtgctaagactatagcctgacttttagtatagtgatctttctgctgaaggtactgcctctcttagtctctttgatcataccaaccctcttatagaagtatggtgagaatttaataactgttaagtgagatgatgaacatgaatgtatttttaaaataaaagtttcttatctcatatggtaccttattatttagtagtaatttgtagtaatattgcaagtaattttagatgagttacatataaattaattatggtcccatgagctttgccaataaactttatgacaataatccatcagtatatgtgcaacagtgactggtgtttgagaaaatatggaagtcccagatagggattaataaatattcaatactagcctcaagactcagacatttgctcatgtctctttccagtatcttgacctcagagaaaaggggtactttaaaagttattttgagaaacttcagatgacagctttattggttttaaagatatgtccacagattctttgatatttctcttctggagagctagagcttaattcccctctacttaaacatggcctggacctaatgactcccttctagcaaacggagtatgtcagaataatgggaacatctgaaactagtttaaagaaaagactgtggtttccctctctctctctctctctttcaattcactctgtattagcttcctagggctgctgtaacaaattaccacaacttgatggccaaaaaaagcagaaatttattctctctcagttctggaggccagagagccaaaatcaaggtgtcagcaggaccatgccccattctgaaggttccaggagcagatccatccttgcctcttccagcttccattggcctcaggtgtttcttggcttgtggcaacataactgcaatctctgcttctgtttatacctgacatcctccctgtttctctctgtctttaccccttctcttctcttataaggacacttgtcactggatttagcactcactcgaatccgggatcatctcaaggtctcaagatccttaacttaattgcatttacgtagatccttttccaaacaagttcacattcataagttccaggtatcaggacacaggcataactatctggagtcaccatttaattcactacatactctctctgagcatggccagtttctatgtcatgaggcagtctagaggaggggaaaaccagctaccatgttgtgagggaactcagacaccttctggagaggcttgtatgctgaagaactaaggcctgcctgcagcaatgtgagtgcgcttgcaagcagatcttctgaagccagcccacagccacatcagtgagcttgggagcacattctcctgcccaatcaagctttccgatgtctgcagccctggctgacagcttgactccaacatcatgaaagaccctgagccagaggcatccagccaagccactccaaaattcctggcctgcagaaactgtgagataatacatatatgtttttttaagtgcagggtaatttgttacgtagcaataggtagctaatgcagcaactatgatcctgaagtttataaagcaggggaaagggctcactatcagagtgggggatatcaatcacattttctcagtgcagaacctgcctgtgtcagagacaggcctaaattggaaaatgaaagccaaatcacatggtgggtaatgttacattatacaaccaaagccctttgccataccattatcataggcagcatattacattggaaaaactattatgaacgaaaacttcttagatagatagatagatcgatagatagatagatagtcaaagagaacccaaagtccagcttagtaaagaagcattgagagaaaaacaacacaaaccaaaacacacaactggatattaatatctacctactcctgttactccttgaccatgctctagtctttacctttgccactcacatgcttttttttactgataagaattactgtttctattttggggggaaaattaattcagtttctgtcctctgttaatgctgtgagctaagtgaagcagaggtaacttctcatccgcatatgttgtgatgcccttctaaatgtgtttgctgtataagctggtgtgtttcccattagctgttttatttttcagaactaccgagagtttgcttcatttttaatcacgtgctatttgtgaaatccctgtaatttcctaaggccttctggagcttgcctcttcctacctgtgacattttcaggaaagatttattctctctgtgtgtttattctgcttagtgaagatcatgagacacagccttaactggagttttgcaagttctttttaaaattgtgtctgtattgtgtttggagtctagttacccatttggaggtctgtggagggcaaagggctctcttgggaatccctttcttttactgatgctcagtgtctgctttctgatattatggcatgtgatgacaaactattgtccttccgtactgggctggttgagtttgttcttgcttttatgttactcctatacttagtacagtatattaaatacatatacatgtcatctctcatgaccttcattctcatgtagaacatatatttccttctgagttataatatgttttgtgaatatggaattcagggattgtgttcagtttgtggagctgtttgggaaagcagtctgagagagtgggtttgggagtggcttgacggaactgggatgaagggcactggggattccccaggaaatccgttggctggcagagaagagctaactgctgtgctggctaagctcatggaactgggctttcctccatatgtccgggatatgtcctacctattgttttaaaattaacaaaagttattttgattttcttcctcctaataatacctattgcctgagaagaacgatgccagattgagaaaccccacatcaaaatatatccaacaaaatggtcagagctttgtacatagaatattccatagttagaatgatccatacagctatgcacaaagagggagccgaaacagggaactgcacatcaagagttaatacagtacttttagcctttccttaaattctctgtgttgtgcaatggcaggatttctccatataccaaattaactgattgccgtgggcactaaacctgttaccttaaacacattcatatcacactacaagtaatatcttatcctttatacttattttgagattaactgtctatcacacagccctctttcctcccatattctcattttttttcttatcactccattcagaaataagggatcgatattttaaaggctgaatgtgagatgtttctatttattgttcatcatggtaattagcaactttttaattatcactgttcttgaggatgtatgtttgggaacagtggagctttcggtagagtcacaatgacagcagtttaaagctggaaagaaatctggaaattgcttttctggcaactgacaccagtttctaggcagtgcctaagaactaggcaaggatttttaccctgttgtttaagactgtacactttgcatctcacaatctatctgctacatagtaagcaaatggttcattcaggcagcaatcactgatttgctccctaatatgtgccaggtgctttgcttatttttttggaaaataatactgtgcaaaaacagacagggacctcaccctcatggaactgtgctgtgctgagctgaaatgaatcaagtgacctgcccaaggtcttcttgcacagatacttaagtgatggaatggggattttacttgggggcccttccttacaatgaaaagacctgatggttttggtcttcccgtctgggatgttctttccattaatagccacactgtctaaatggttaataacatggactttgaagcccaacattctaggctcaaactcaggctctggacgtgggcaagttgtttaacctctttgtgcctccgttttgctatcgggaaataggtatgacaatcaccctaccctcacagggaggctctcatgagttaatgtctgtgtggcactcagagcactgcttaactccaagtgaacactgaacatggttagctgtttttcagtaagatcaccccaactattttatctaaaatgtcacctcttcactctctatcttcttgccctgctttggttgacatcacagcccttataatcatctgaggttatttaatgtctttatttttttttttgctgaatgtttttcttttccactagaatataatcttatgaaagtgaggactgcattcactgttacatctccatattctaggaacatattcaaaaccacctgtgaatgagcaaatatgtgcacatagaaaactttattaatttaattaaataattaaatgtaattatttaattaaataattacatttaattattttaataaatttagtataatttaattatttataattattaacaaagttatcagaagaactagcctaagagtactttcagtttcatgctctgttcatttgattcctctagtaacttggctaatagatacaaataagccaggaaaatagcatcaacatatggtaaggtcaagctcatatttcatatttaatatacctaccaagcaagttttaggtgtgctgcacatctttttcatatttttaaaagtctataatttaagtaatagtgtccggatgaaataaagcaagaaggaagaggtttaaagaacttcagggacctgagagccatgttctgacctgcctaatgaaaagctcatgaattgatagtgaggtcctttcccccgatacagagtcagcgttcaaagtctatttctaagctcaatttattgttaaatctcattaaaataaagtgataattttatgggtttgaaatgtgttataactgacttttctgattgagactgctagcccaagtgcttacaacttgcttaaatgttgtaaatgtgttaaaagggggaatgttgatgtgtatttcctctgtgttcaaactgttcagattttatgggaaataataaagctttacaacttgttctttacaaatagaatgctagggactttgcagcaacatgagaaatctatttattattttgtgtcagagcaagctgggcatcttcctctttgtagactgccagagttcattgttatttgggacagagaaggaaatagcatgatagtcagggagataatattaattttacagaaatagaatcttattttattacaaggaaggccgtcagtctcacaacttgcactctatttgtgaagaaatattcttaagcatatattccagtaatatgtagtttaatacctatgtgaaaactaatttcttttcctcaagcatcaacttttatcacagaactttaaatctagaagtttaaagtttaaactttttaaatctagaagtttaaagtttaaactttttaaatctagaagtttaaagtttaaactttttaaatctagaagtttaaagtttaaactttttaaatccagaagtttaaagtttaaactttttaaatctagaagtttaaagtttaaactttttaaatctagaagtttaaagtttaaactttttaaatctagaagtttaaagtttaaagtttaaatctagaagtttaaagtttaaatctagaagtttaaagtttaaagtttaaatctagaagtttaaagtttaaatctagaaatttaaagtttaaatctagaagtttaaagtttaaattttaaatctagaagtttaaagtttaacttctccttatattaaaggagcagtatgaatattctttgagagatgaactttaaccatattttgtgtgtgtgtctctgtgtgtaatatatacctatagaccatagtctggggaaaactcatttttcacttcttcttttcatgcaagatcttaggtgctgtattttgcaacgtgccgtgtagcattacatttcatgatattataagctgagttttatagaactgtttcaaaaattttcattatggaccttttatatcataattgagtatctagcaaaaggtaaaaaaaagttccacttatgaagctgaatatcaatcactcaactattcagttatgcttaggcatagatgagtaagcttgttctttgacagttaagacatatggtggtgtgtgtgtgtgtgtgtgtgtgtgtgtgtgtgtgtaatagatgtgccagataactaaaatctttgcttagtactttgagggaaaaagagattcgtgatgagtgcatttattttattccattctatccacattttgtataaaatccatttaaacaggggaactaaattgcttacagtagtaaaatgcatttccctctgtgaatgttggtgcctttatgatgcatgctgatttggactctgacacagtcataatctacataccaaacataggcattttgctttcaaaacagaaactggcactgctagagctgtaggagtgagctggctcaccagagtaatctctccttcttggagagatttggcttattgttgatggcctgaagtccactgtcttggacctcagagtgggctttccagtttgtagtaatgggttctgtagcatgccaagactatagagacccccgaattcatctcttttatttcccttctatgagggaattcctgtggtcataaggcctgcagcttaacagatgagcagaaaatgtgctgaaacattggtgcttaaaaatatacaaaatataagtgggaatcagtgtctttagctttatctttgcaatgggcaaaacagaaatgactcaaaagtgatttctttagttatggagcactcaggtttctcttctgccttttgtatttccatatgtcactgctatctatattctgtagatactctacctgtgacattctgggattataaatatgtgagttgcatgcttattcactttctcccaccttttcattctatcctgagtagtctaaactgaaagcttttgaaagccttgcatgttttccacatcaacccttgaacatttatacttctaaaaaaggatgctggactctcttgataactctgtccttcaagtttgcctcatcggtgatgccacttgactgaaagtcctcttggtaatccagtaattaaatccttctagctgaggcccaagagagatccctctgctgaattgcactgcacagtaaatgacattataatgaggttttaacttattagttaaatgaatgaatggaaactttgctgctgcaattcattagatttttacgttataaaccaggacttgctgctgcagatgagagtccgtgcaattttcccttcgtataattaattatcatatcagtgtattaaagatagtttcactaaaaggagaaatacccttgtatagaaagtctaagacagtctaacaaaacatggtgatcacttctgtatgtccctgagcttggtgtgataggcactgttcagatacttctgcaatattatcaaattttaatcctcaaaacaaccctctgtgatagttactgttattattcctattatatatgaggaaaatcaggcacagagaggttaaacaactttcctaagatctcatagctagtaagggtagagcaaggattcaaactcaggcagtctctctctatagctctgcacttataaataagatttcctctcatccctagacatgaacatgaagatttgcttatatataaattcatcttattgatatgtttcttttgaatttcttcccctttttctaatgaaaactgatgatgctatttagaaagctttatttttttttacctaaaatgtttaatctcagaaaagtactgagaaaaataacagtactcatgcattacccaccaagaattttaaacatattaacattttgcctctttatttctactttttgtttttaaaataaaataaccagttatttctgacaaattcttcttttcagtctcattctttccttcccctctttccattccttgtccagagcaacccactcttaagagcagaatgtaaatccttccagactgtgttcttatatttctaccagaagcacggaaatagccataatccatatacatggtattgtgtttttaactgtacacaaatggcctcatggtgtatgggctgtactgtttcttggctttttcactaaacattacatatgtgtgtgtgtgtatatatatatacacatatatgtgtatatatatgtatatatatgtgtgtatatatatgtgtatatatatatacatatatatatgtatatatatatacacatatatatgtgtatatatatatacacatatatgtgtatatatatgtatatatatgtgtgtatatatatgtgtatatatatatatttttttttgagacggagtttttctcttgtcattcagggtggagtgcaatgtcatcatctcggctcactgcaacctctgcctcctgggttcaagcaattctcctgcctcagcctccctagtagctaggattataggtgcctgccaccacaccctgctaatttttgtatttttagtagagacgggatttcaccatgttggccaagctggtcttgagctcctgaccttacgtgatctgcccgccttggtctcccaaagtgctgagattacaggtgtgagccaccacagccaacctaaacattatatttttaaaacctctccatagtgatctatctagctataattcattctcagctgctatatttctttcttgcagatacaccatattttatttgtttattttcctctaaatgggtgattagttgtttccaatattttcctgttataaacaatactgagatgaacattttttgggtacataatgtctcacatactttgcctcctggatcgggattgctggttgggagggactgtgtggtaaaatctagcaatgaacatagaagagcaacagctgggaaggaggggtatgtcaggattacatttgagaattagagaacaaagtcacgcaggaatatttactataattatgagataataataaattacactgctaacagatagcccaagtccatacttcatgaagtctctataaacaaatgttaggtatatgtgaggtttaataaagagaactctaggctgagagccaagagacttggattttctctccagctgtgctctaacctagctttgtgccatagcataatacattaatagagttgggcacagaggctcacacctgtaatcctagcgactagggaggcttgaggccaggagttcaagaccagcctgggcaacaaagtgagatcatgccactgctctccagccttgattacagagcgagaccctgacttattttatttattttgttttaatttaattacttttttttttcagacgaagtctggctctgtcgcccaggctggagtgcaatggcatgatctcggctcactgcaacctctgcttcccaggttcaagagattctcctgcctcagcctcccaagtagctgggactactggcgcacactaccacacctggctaattttttgtatttttagtagagacggggttttaccatattccccaaactggtctcggactcctgacctcaagtgatctgcccgcctcagcctcccaaagtgctgagattacaggtgtgagccaccgcatctggcctgagaccctgacttcttttaaaaaagcaaaacaatacattaatggtctctgaatctcttttctcttatctgaaaatgaagaatttttggtagtattttcttatgatttcttccagcattaatctacccaagttaaggctggaataagtttcctttatgatattaatacctctcctcagcattgaactaaatgatccacaggcccaaatcttcatcgtcccccaaactgctgccctgttgtccctgaatatagcgtccatttgtaattccaggcagtgggctgtaatgggcccttgatttattgcgcccttttcctaccgtgtaaatagcccagctcactgcttcttgggtgggataattatgaaccttgtggccctcagatttctcagtgggatcgggctccagttacccacagtggtaactggcttgataacagcattgtttattgtttctttcctactcctgtctcacttctctacttctggccattgtattctgaggtcacctgagattcttgtctcaagatcttcttgctggggaaactcaaaggaagatatccacctattcaaatcctgcctgttttcctccctctagcttcattctatagccttggaaggttcgtcctggcctgttcaagcctgttttcctctctctagcttgattccacagccttcgaagtttcttcctggcctgttcaaacacaagctcatggagctgcaccagactcttaccacatttgtcattggaaccaagtaatgcaacatcacatatgattatatgcgtgttctttttttaaattttatttctcacagccttggaagctgggaaatgcaaaatcaaggcctggcaggggctggcttttgagacagctaggtgttagctgttacttcctatggaggaaggggcaaggaacctctcttgtgtctctcttttttttttcaatacatttaatagtatatatagttaaggcctataatatgagacacattcagatagtaaaatgattactatagtgaagcaaattaacagattcatcatcttacagtttcccattttgtgtatgtgtgacaagagcaattatatctacttacatagcaaaaaaaaatcccacatgccacaccactttcttaactatcctcctcatgttgtacattagatctctaggcgtgtttattctacccgtctgttactttgtatcctttgagctacatctctccgttcgtctcacctacattcatgttcgtactttttatgtcccttcccctcccaagcataatataaaccgccaagagccaggaactctttttttaatttcatttttattaaaaaaaaataatgcccctctatgcctagcatggaactaatgcagaatgtacccatgtagtgtattgtcactgaatgaataatttagtctgagtaagtctatatccccaggactgattttgtggatgccagccatctcttcttggatttctttgccttttaattaacttcccattagacttgtggttcttagtgacctcctgagggcctgaaaatcagaaggttgcagactgggccatctattttatgggagtaatataaagacatactctctttggtcacgttttcagaaccttttgactaaatgggcagaagtaattgggaataaaaatgtgttgggaagtagaagttataatttcttatttttttctaataaggactttaattctaaattcattcatagctttgttttaaagttattgtcagtattttatgaagttaaagacaaattcaaacattaatgattctagatgttttgcttcaagtatctttgccactgtttcctcctgtgagatggagtctagattttctttccttctcttcctctctctctttttcttctcttcctctctctctttttcttctcttgtacagaataagcctgattttttttaattttgtgatattttaaaaattctcttttattttgattgatattgcatatgcttaaaaattggtagaagaggctgggtgcagtagcacatgcctgtaatcccagcgctttgagaggccaaggcgggtggatcatgaggtcaagagatcgataccatcctggccaacatgatgaaaccccgtctctactaaaaatacaaaaattagctgggtgtggtggcacacacctgtagtcccagctactgtggaggctgaggcaggagaatcacctgaacgcaggaggtggaggttgcagtgagcagagatgatgccactgcactccagcctggtgacagagcaagattctatattaaaaaaaaaaaaaaaattggtagaagaattcaagtgagtgaaactgagagtttatggttttctccagcaaatcagtgagtgttttccctgaacatggatgctttggctctggtcttcacactctgtgagatgaggaccagcccttgtggcctctgacttccaagacttcagtacctgagggtattattacatattttatgagtttaaaaattgaggaaacttttttcccctccaacagtgaaacattctatttatcatttgttgaacctgtctagtgagtactgattttgtagaatacttccccaaaagctgattttccagattcagttcttttcaaactgcaaccagcccggctgggcagacagccctctccttttgctccgctttattcttcctgaattgactttatcactgtccctccagccatttccaggattcatcacagattatctctgcttgttggcagaaagcaagcaccgccgagactgaagggcacaattgccgaaaggttcttctttcagttcagtcctcattctaatttttaacttatttggtgctgctgtggaaaagctgtttgcctgaaatatggtaaataaataaataatatcctacatatggagtccataaaataggatgcagaaagctaggagctcaaatttagatccaaggcagtaattctccttgcttctttttccgcttcccttcttagcctcccttttctccttaaatgatcaggctgaatggggttgtcaggattgaaagaacaggatcccagattttataaaattgtttactcctctctgtttgaaatgtgtaactttgcagaattgagtgtaattccagtcatctcctaaaaggctgggatgatggccagggcgaatgggcttcctgaccttttctgtgtggagaggcttcacggaggagcactgagggcagaagacacagagccagtcttccatggaggcgacccatagcagcgggatccagcaatgtgtgaagtcatgctggttttacatatgaaccaatttgaatagaatccttcattttttttacataaatattacatcttaaccttttcatagaagagcctcggttttctttccaaaggtataaaggcgaggtctgtgtttccataagcagagaacatttatcctctgtcctgcctccctctagaacaaaatccattgctgtcttaatttccagttttgattgtagctctcagtgtgagacctcccagtgctgtagagtgtgtttcctctatgaggctcactcaccacaggcataaagatcggggtgaatttcccagccgcctacatccgggaatctctcattcggactcagcaagatcatttttatttttgaccagaaccttataaataaatcacaaatatataaatgtgatagggaaggcgcccatcacaactatttgttcaaacaaatcctgggcccaaagaaggagtgaaaaattaacttcctatcactttattttagtagttcatactgacagcaaatatttaattatccattattttgaattccacattaaaataatactcataaggtttggattaatagaaaatactcatatttataatagttagagctttccagatacatagaggcaatatagtctagtgcttggtaattccctagagttggaaaccttggtttaaacctggcctttacatcaaacaagctatgtgtgcataggaaactctgagctctttgtttcagttctctcatctgtaaaagagacacaacaatagtgactaactcacaggattgttctaaggataatatgagatgatgtgtaacacatacaatacctaaaacttggtaagcactgttaacattaactagtaatagcatttcagtctcttttctgttcattacgacatttaatcttcctgataacctcttattataatatacactgtggtagactaactttgctttaaagggccagatagtaaatatgttcagctttgccagctgtatggtttcacttataaacactcaactctgccagtatagttcgaaagaagccaaaggcaatgtaaatgtaagggtgtgtctgtgttccaataaaactttgtttacaaaactaggtgtcaaatgagatttgacctggggactgtagtttgctgattcttgacaactctctacttgctgttacaaataagaacatgaaagcagcttggttaggagattgactgtgagaacattgctacttagtggtatatttcaaagtaatatccatttttttaaaacttatttcagggcttttctgcacaactttttgtttgtttgttgcttttattttgagactgagtctagctctgtcacccaggctggagtgcagtggcacgatctctgctcaatgcaacctccccctcccacgttcaagcgattctcctgcctcagcctcccgagtagctgggattacaggtgcccgccaccatgcccagctaatttttttgtatttttagtagagacggtgtttcactttgttggccaggctggtctcgaactcctgacctcgtgatccacccacctcggcctcccaaagtgctggaattacaggtgtgagccaccgtgcctgacctgaacacctgtttttgatggcaatttcttatctagtgatcatctgcaatgtctgagatatagacttatgtacatcattggttagagtgtgggttgatgtgagcagtcttctttgactttgttttatagccaagagttcagctttaaatactgagcaaacttcctgccagcatggattttggttagaaaaagaaatgggcaaaagtagatgcctgtttcaatcctgactgaggaacaaatgtagcacctcaaagcatttctttatacttatacatttctttaggttttttatataacactaaaatacttacttttttttttcagtcaaaaatatattcctgagttctaaatctttaatttgggggacatggatcaaaattttgaaattttggttgtaaaagacacctagaggggcacgaagtctgtggcttgtgcaaaatcttttacacatgcttcaaggatgcacacacatatacaaacacacactctcacacactcacataaggtaaggagggtgtttgggtgtataaaagcaaacagtagaagctgcctcaaaccactgtatccagtatatatcctgatccaacatatatgtatttagattcaaatttaataggtctggcgtcaaatttctgaacccatcacaaagtagaagcaataaatacaaaaaaggcatattgttcataaagcgtgactggctgtagcaagagatgacagctgacctttggatactaaactagccataaaactgaaaaatcatgccatgataccttgttgaatcacttcttaagtaaaggttaacttacatacattacattctgattgtttaaacagaaacaagtgtagtatcttttaggattaggtcattttaaatttattctgacaattagaagttttgattcttcaatttgttaaattgagttttctggaaaatgtacctctttctgaagttgaagttggataaatgtagcaattccacatgttcatcaatgtgttacagcctaaaattcatcttttaaatgagaatattaatttcatgtttataaacatattttctaattgatcaactgtatttatttttatttatatatttctccatgcaaaatagaaatagctctttactcagatgagtgatactgaatctaatataaaagcaaatttgtatagaagaaatccagggacagcagcggtcagaagataattcacaacttgatgaggtaaactaccttgaatacccctgagaatgagagagtaagcaaggagacctcgagtggccaaagcagagatttcagttatatttactggacaaaatggacaccataatcaacagggaaacacaggatgtactttgggtgagtggtaaagttctgcccatatgaaggcatactcccatttatttgctcagtcttggcctggtgacaggcaacaaatattgaataagaccctttaaatgaattttcaaaaaatgaagtttagtgatttaaatagcatttaaaaaaatcaaattcatagtaagggtgcagtaaatatttggtttacagtttcatcttgcatactgtggaaagacgatgagcatggaacttgttatcaccacgtagaattcctaaaataattgtttcaataaatacggaatagtagctcaggtttcagatttttacatgttattgactgagcctccctttggggaaaatttaaaagttaaaagatctcttttaagatgattcagaaatgcaaggtttatttaacatcttcctcattgccatattgtgttctgttgttttcctcatatcatgtaacttattatcattttttattacttagtttcatttttacttcctttacctactcactcattaattcttactgccagtattttaaaacctttctgcaaaaaaacacatgcaactgcactgggtcagtgtttctcctgattgataatccactttccacctccacatctaagtatacaatcattgataaaaatgaagcccccatggactcttctcctgagagatctcattcttcctgcttatcagcttctgccctctgtctgagggattccatattggcatctccgaaatggagatattttcctatcaggtgtattggagttaaaattgagagagaacatgcaatcatttttatcttttcctgaatcatatgcaagtttagcaccaggtcgaaaattcaagcttagacttgtttgtgctctaaagattgagaaagttgctcagattgctctggagtgggtcatgagttttcttcctggatttttgttcaacacagatagccatctttgatttattggaacctcttgctagagcatagttataactcccagagaatccttttgaagtcaatttcagctttttcatattcaaggaaaagaggaataaatcatgtatccatttttgatctgtagtttttcaggaatcattctcaatgttgttgaagaagttagaaaagcccaagctaatcactgtatcatataggttttccgaaggcaaggtgtagaaatttttagtgttgtttaagcaacccatttattttgaagtattgaaatgttattaatcctaaagaccaggtgatagtttatatattcttgaaggctttaaaaatataattagcctctctgttacaaattgagtccacattcatcttggggctaatttatttcctttacaaaactaacgagtgtttgtctacaggatcagtgaactaaatctaaatgggggccaaaccttcaacttcaccctctggcaactctttttcccattttcagaactcttccaaatcccccgccccagccccagtatttccaattgacttatagaaacagttgcattgttcttttgcccaaatcccaagcattccccagagagctgttttcactttctttagagcacttacagtttatctctgtaagagaatagttttgagtttggcacttagtctgtttctttttcattctaataggaatcgccttagagctagctaagtccctgttagtcagcttcttaagtgctgaccagacttcttccatctgtatagaacactcactttttcacatcagaggtttaatgaaactagaaaagaaaactctttaaaataacaataataatgaaaatctctaatagattcaggcaactttacatatatcttttcaagattgggtcaattttgcaaaaattttgagggttttattttttaatatggcctcaggttagagtcacacaaatcagttaaaaaatatatttctttgagttggaaatacacacttatttcatccctgtacttctatataggggagttatttttaatgagaaaaatttatagctgactgccaatgacacataaaaattagtatgcattattaaaaataaattaaggcagaaagcagccaaagtggactttgttctagagtcttggtaaacagccaacagcagtgctcacttgtcttcatgtgacattaaatagtgcccgtctaaaaagtgattaatagataccgcgggttggaacaggctggcattcgtctgtttcttacagctcctgatacacgttgaatgccctgcatacctatagttcttaagggaatagtcactgttgagacatttagagaagctgatatcagatgagggcaatcttgttttggctattttaccacatctcaagtatacaaagtctacatataaacattacgtaatgccttcagacattgcactgattcaaatagattttaatgagaaaggccaacttttcctgtttcttggtcattcagagacttttagggagcttgaattgtcagtatctcctaatctctcaactatttttttcttttgatttttaatctcactcagttagactgttgggaagagaatacaataggaggattaatggctcagagcagaaatgtttgcttgttggacaataggaagggaatttggtagaagttcttacccttcctgtttacattcagtaatgttgctggtatattgaaaagactgtcaatagtgggtatatatttttttcaacagtaatttccaacatcttgttgttaggtgttcatcaaaataagaaagacggagaaagaagaaaacagagacaaaaagaaaaaagataatggatttgagaagtcaagtcaattcagtcacaatatgggagtaaaggacagattaaaagaagtttcttgtgtgagtgtgtgtgtgtgaatgagtgtgaaaatgcgtgcatgggtacatgtgccttagagtagaggtaattggaagacttgaggagaaattactcacttttcttttaataccaatgaccagacagcttgccaggtgctcactcagatttgtatcatatctttacatactgtcttctggataggtacaactatccccatttttcagatgaggacacagaatcttagagaaatgaagaactagatcaagatctgtttgaacgtaagtggttgagtcaggatttgaatacaggctttttgtttttatcactccagagtctcttttttcttccttggtaaatccagacttatcactggagattctggttcaaaattactctggcagttttaccacctaatatatgttactccaagaattttccaagtctgattaaatagattaggtggagtcctccgaaaccctttcctgatttcctgggccaaggtaaagcatatctcagagcaaattttaaacagtactttgtcattgaagacctaactatatatgaagcattgtgtaggtgctgagaaaggcacagaaaaatatacaatagggcacttgccaccagtgccttattaattagataaagagataaaacatacacctgtgaaaagctaaaaaaattactattatcaattgacaatttggcatagcaaaacaaggcatgattaattgccagataacacaaaatgcatgtggtagaatttgagagatctgtaattggacttcagtggcctgataattcttaatggaagcggtttaagctggagggaaaggatgggcaggatttagacagggagaacagaggtgggagatgaattcaggccttaacaaaagtgtaaagaagagcaggacagcaggaggctgggttgaaggacataaacaacaggaaggtaagtaaactactttggacaaagtggggctctgcatagataggaagtggaaaagcaacctcaaaaataggttgggctcaggttttcaatcctgagtgccagcatagactgagcctgttgccatgggtacgtggaaaatgacagagtcagtattgcactttgagaagattattcaggaggcagggtgcaggatagaggacgagtgtctacaaataaagagtgaggcaacacatatgtccatcctgcattgggccacaccaagaacctaccatgtgcacctctcaccacccactggcgctcagactgctgcacacagtagcccccaactcatctacccagatccacttttgtccccatccactctgttctccacagtttcagccagagtgatctttacaaaacataaattattgtcacctcctgcaaaagatttcaacgtgacccataaatatattcttattttttcctccatgtcctatccctcaacatgacctacaagacctggcctctgccttctcttcggtctcatccttcaccctgctcactcttgttttctaggcatggtggtctttttaaaaactgtgtctcattctttgtgttcaacatgccccctctcatgatagggactttgctgtttcctcttcctggcattctcttctttcccctcattgtcttgtcaactcctacttatccttcacatcaacacactctaatttcaagacctccttgactaggtcagatccccttatagaagggtctcacagctccaagtaactatctctcctttgcagcttttattacatgtgcggtttcaccacttatctaatagttaattcatgtttcttttccgcagtgtccacagtgtttttgttctttatttaattcaagaatctagctcttagtggactctcaataaatataatatagtggaaacaaaataatatgtggttaaaatgtaaggtgttgtattagtccattctcatgctgctaataaagacatacctgagactgggtaatttataaaggaaagaggtttcattgtctcacagttcagcatggctggggaggcctcaggaaacttacaatcatggcagaagggaaagcaaacacattatgcttctcatggtggcggcaagaagaatgagagctgagcgaagggggaagcctcttataaaaccatcagatctcatgaggacttactatcacaataatagcatgcagaaaactgtctccatgattcaattacctcccactgggtccctctcaccataggtggggattatgggaactacagttcaagatgagatttgggtggggacacagccaaaccatatcagatgttataaaaatttctatatttgaaggcctcagctattggcaacattacttaattttaaatacatttggcactgattttaaaaaagtgttacatagtattggaattattttcagagggctgaagaatccttcataccttggagagtgagtgagcactctttagcaggcctcttgtgcttccaacctaaatgcaggcaaacgtcctgttggtatgtaaagctgccacccaaatgcagagaacctctagagtgcatgctgttctcattcaaactgtcccatctgttcagacatggtcaagctctctgagccctgggagaacgaaaacaggccaggattaccagtttttacagattttaacgtgaggcttagggtctgtgggctaaaaggttgattgtagtttttaagttaaacatcaacaggggctgaaaagaccctaaaattacatttgggagtcatacaaagacaatacagctccaactgcattactcgggacctttttgctgctgaaacagaaaaaatgataattaaccaatcaggatgaaatgtcaatttgagaggaaggtaatgtgaaattttcctaaatcatctaaacaccaaaaaatctgttacatctgatttccaacctgctctgttgctatgaaaacttactctccactcagctctctgaacgctacatattcatgcaattataattctttctgaaagatggactctgtaatgatatgaaggcgttttccttcagtctgcctagagtttttccagagccacttaataagagccatgctcttttggaattattttgctttatccacatttttcttcatgatccaaataaaagatagttttttaaatgtgaggtggcagttgtcttgggatatatctctatggcatttgctaaattaaagctcatcttttcaagcccagtctttattttgttttcctatagtttgctggcaaaatcaaagcccttgcttccttactcttgcactgtggagcagactggtaggatgatcacaggggagtgagcaggcttcagtggttcttaaaaagacaatttccatttccttggcagagggaccccatactgcgctccagccaattcttaattctttctgccattggttccgaggggcaggcttttgtggggagggattatttgtttctttaaaatccaccgtggttcttttccctcccaccttttcccctttcttttgtggcctggaacaatacaatgttagcgattcagtttctgacttgcagagaatccatctatgcttggaaaaatgcagttcaattatatactgcagcttgaggtgagatagaagtgaagatggcttaacacgtgaagtgggtaaaaaaaatgtgtaattgaaacagtatgatgttgatgaggcagtgtgtgaggctgtcaggaggcattataataagctgatgaacgagactagcttcctagttctgctgtatgcaaatgttccattatttttggtggaggaaaggaacctggcatattaattggctttgtttttagagatgcaggtgaagccttttcattttgctttctgaaaagaaacttgcaatatgtccttaaattatgtttaattttgagtgtcgacttacaaagaaataaaaactcttcatttttaaaaaatttaaaacaaaaaaaaatttgggggtattgaaccttagaaccaatcactaaaaattctgattttgtgtcgactaaaaattctgattttgtgtcaactaaactgcatatgagatcttcgagtttttaacactgaaacataatagttaattttttaaagtactataaaacagaatatagaaaataaattacactatactatattttctatatttggaagtttacagttgtttgcataattgacaagttcgtttcctggtgcagtcatcagcaggttatacaggatgtatctatctgtctctttcttcagaggacactgtgtgtgtgttgagaatgaaaccgaatgtgggtggtaagaggaaatattaatgaacttttaaatatctctttccttgaaaagactgaaatatgaggtcttaagtaaaataaatcatttaaagtataaaatgcttaaagatccttactttttattaccaagttattagcagactgccatactgaataccttttatgtagttttttttttttttggctaacatttccaaacaactttaaaatatagttattcattaaccgacttgtgactaatctttttcagagagagaggattaactttattcctctccagttttaacgtgaccaataaggtgatatgcaagtgaggatttggggaggtggggaagaattggagagaggtaatagaactgatccttgagtcagtgggatgttggaagtggttttccattactttccttggttctcagaaaaccagggagatagggaggatgttatcaggccctttgaccttctggaagtgactgtggacttagcaaaagctagttggagctaggggaggaaggaggcagatagataaagtaggaagaaataattgttctccctaagcacagaatccaaggtggtgctattaaaacaaacaaaccaaaaatacacacacacacacaaatgcacacacacacgtctgtgaatgtatacagagatggtgcggtggctcgcgcctgtaatcccagcactttgtgagcccaaggtgggcagatcatgaggtcaggagttcgagatcagcctgaccaacatggtgaaaccccgtctctacaaaaaatacaaaaatttgccaggcgtggtggcacgtgcctgtaatcccagctactcaggaggctgaggcaggagaattgcttgaatccaggaggcggaggttgtggtgagctgagatcacaccactgcactccagcctgggcgacagagagagactctgtctcaaaaaaaaaaaaaaaaaaaaaaaaaagaagagatatatatgtgtatatatattaatatgttgacaccacagagtacagtattagaggaaacagtgtgggtgcatgtgattcaaacatcagttgtgaggccgaaagagaagctagtcaacaggtgggggtcttttaactccttctctccctccactgatacagaacccccaacactcatatacagtgtgtttccagaaatccaacctggctatccctttgaggctgataaaggagccaagtatccaacctgagatcctgtggttcatggagtctgagttcctattgaacacagatcatggttgcctggatgggaaacctggtttaaacatttaaatgatcagaatcagagcagcctgaaacagtcatccttgatgctcaagttcctgagaaataattactagaaacaaaatttcattgtttggaaacttttccagaaaatgataaaataatactcgtgagaacatagatcacagaaaaagaaagttcagttctaatgtagtatgtttcttttacctagatttattcattgttcctgtgtttattttctttaacaaatataaacaaagaagaaaaggcagcctcctgtatagaatgcttacacattttataagttaaaaatacatatagtcagccgggtgtggtggctcacgtctgtaatcctaacactttgggaggctgaggcgggcagatcacgagatcaagagatcaagaccatcctggccaacatggtgaaaccccatctctactaaaaatacaaagattagatgggcatggtggtgtgcacctgtagtcccagctacttgggagtctgaggcaggagaatcacttgaactcgggaggcagaggttgcagtgagcgagatcgcgccactgcactccagcctggcgacagagtgagactccatcttaaaaaaaaaaaaatacaaatagtcattttatagtttagtctaagcatttattacacatttcaaaagacaaataaactctctcctacttttgtccacctgtaagactcatttcagtacctattttattttctcctagtttttcccatggtcttagtttaagaattcccaaattctcacttattgaattcactcacagaattctacttcccactacagttctatcaggaataggcaagatagaaagaaaaaaaaaaaaaagaaagaaagaaagaaaaagaaaataaagaaagaaaaagggatgggaattttgcaaacatgggggcctgattactaaaagccttatgagatgctcatactcattctttaaagaatattggaaataaatcagtcatgcatttaattaaaccatcctaaaatgtgcccctcttaaaaaaaaatgagtgccataatacttcccaaattcccggaaatgttgtatgtctaagaaagcaagatctgaactgtaggtgtatttcagttggaaattgtagtttacattacttctaattcgaggcctatgtttggtcattaaaagctcccagctaaaaacagtgaccctgctctccatgtgtgcgcaatcttcagccaagtcccaccagagcattggcccttcagtggagggagaaaggatgatagaaaaagaaattctgtggatgtgagaggttagggatagaagggtatttgggcagctctggctatctcatatctggaatttcaccttttatcttcctggaggatgactccttatatggtctgctttgtagaccactttcttgaaaagcaattgcatataatataaaacagaggatgctgtgctaaaaagaaaaacaaccctccttttattgatacttttttctcaaatatagtgatcactacacgatagtaataatggtttgatatttgtaaatcttaggtcttaggaaaaaccacatatggtctgttaacctaaatgatctttagaataaagtacagcgttctaatcaattcaattcatatttcacatgtagttattctttgactaaacaagtactttttgttaaaggaagcaggtaaactaaaatttatgtatttcctcttctgaagtccctgacgtagttggtttggaaaaggtctccaaccaaccagggtgctgaacattcatcctgagtaatgtgctgttttggttgataacagttgtcatagtcatttcctcctttagttagcattttggcctaaaggtagtagatttatggtttttagcctgtttcatttcccagctgccccacaacttttttttttttttttttttttttttttttttttgtgaggcagagtctcgctctgttgccaggttggtgtgctgtggcgccatctcggctcactgcaacctctgactccctggttcaagtgattctcctgcctcagcttcctctgtagctaagattacaggcttgcgccaccacctccagctaatttttgtatttttagtagagacggggtttcaccatgttggccaggatggtctcaatctcatgacctcgtgatctgccctcctcagccccgcaatgtgctgggattacaggcagaagccactgctcccgcccacaaaacttcttttaaccacatttacaaattgctgggtgcttctgcatacacacataatgaattataaatattagataaaaagtatgttgaagtaaattgaacattaaaactcaaggagttggccgggcatggtggctcaagcctgtaatcccagcacttagggaggccgaggcgggtgggttgcttgagctcgggagttagcgaccagcctgggcaacacgatgaaaccccgtctctactaaaatacaaaaagttagctaggcatggcgttgggcgcctgtagtcccagctactcgggaggctgaggcaggagaattgcttgaacccaggaggtggaggttgcagtgagccgagatcgtgccacttcactccagcctgggcaacaaagcaagaccccatctcaaaaaaaaaaaaaaaagaaaagaaaaagaaaagaatctctcaaatgtgaaagtctggatacacaactatgtttgcacaacgctcaatttggcataattataaattgcactccagcctgggtgacagagcgagatactgtctcaaaaacaaatgaaccagaaaacccccacaaaactcaaggagttaatttacatttagaccaatctagatgtgtttaaaataaaagtaaaaatttcagttctgtaagaagtgtctactggggcaagtacaattagtcctggcttacacatgagaaataattgcctattgtctattattttattgcctaggttactgccaaagcttgtgggtgattcctctgaccctttgtactaaaggggctttctgaattgcctttcttcataggtttcttctgtattgaaaaggctttcatggcttttcatgtccttagaatgaagttgaatttcctaagcctgacattcaagactctcctaaatttagatgaaagttaccttcccaacctcatgaatcattatgctaccttaagacaatttcaaccaagataggcttttccttgttacctccatgacttccttcattcagctgctctaaccatgcagtgacctctctaatcctccccttctcttaaggaaccgtgtggtagaaattatatagacttaggcccatgacagactagaattctatgttggaaaagccactgcttccctctggggctcagttcctgactcagtaaagaggtatcagttactggcacagtaatgccccataacaaacaaccacaaaatttcagtggcatagacacttatttatccttcatttgtgggtggctgggctcagttcaagacttcttcataagactctcattttttgatgatcagtgagagataaggattgtttttctcatgggcttggcagaaaatctgaatgtacatgtgcaattcaaggctttgctggcgcagtgtccactttggcctcagaaagtcacatcatcagagtggggaaatatagtccactcctagtgggaggaactacaatgtcattgggaaaaaaggcatagatatggggatgaggtaaagaattgagaacaatgatggagcctccagtagtattattaagaggttaactcagataatctaggttaggtttctgacagggcatgtggcacaaagaccctgaacacgtttttctttccccctgtactttcctcacacccacttgttcaaactctccttcttcctttagtcttgcagctgttattctatcactggcacttcctgtgcttttcacatagtaagcagtaagtaaatggtttttaaacataattctataatcattatttgcttttttattgaaatacatatggaacagcctatatgtagcccttgtatcttctcatcaatcctaagttttaagttcaagtagaatttagttgccaatttagacacctatattggttcccaaatgtaatgaaacaaagctaataaaattctttaaacaaaaaacaaaaacaaaaaggtattgtctctgcttcttagtagcactttctctatagccatctctttgagtgatgtctgactttatcttctgccaaagatagataatgtttatatcagacaaaaaaataattataataacataagatcgtaagaaatgacttgtcagcttatattaatctgactttggtctctgatcatggccaccagatatatttggtggaaccactcccttgtcagaccaccttgcaggttaaatctgtaacccaaacacctccccacttctcttttaattctcagctttttaaactttaagtggcttaaatttgatctttacattccactgtcattccagcacatacacaaaaatatgtattttgtgctatctccttggtgtagtgactgtgtggtaagatggaaagactattattgagcttggaatcaagtccctgctttggcacgcgttagctgggctgcagttttctcatcaggagcatgattcagattgtttattcttatatatcctttttgattattaccttttgcagctctattcactggaaatgaggggactagaaaagagaaaaaagagataaaacattgactaacgtgtctttgtgccattttcagtcactgctttggaatctggcaggagagctaatattcctgtttcatttttattgggcttaaaatatatgtttatcttctcttgatgaagatttggtattttttttatccctcggatttcttctttgaggtgactaaatgtgctgtttcttagaaagcttggctggaacttttcatctagtgtgctagagtctctataaaacatatctaaataattttcaaagactttgctttaaatgcctgttgaattctcctgggtaatattagctgagtttcctcatgtacatttggtggtacatttttataattatttctatttggtgctattcggcttttcacaaaaattatgtatctggtcatatcccttggtctgtgggccattgtgactcagatttcagattgcatacgtatgtgttaaatggagtttcattctcgtaaaagaaaccttactgaacatgaccactcttctagtggtttccatgtgaaatgaattatgttctattgtaatctggagtcttttcattttcctgtgagaaatggtttgaaaattgtattctgttgtttacactgttgggtatctcttaggaggcttatacagaggataagaactaagatagctttgctctccttacttcttggtgtatctacatagcataaaaattaagatttatttcttaaggactatgaatgttttgtaacattcaattttgagacattcaaatatgctgagtgttttttaaacagatactctgtaaaaatgaatgtactaagttctcagactaaggtgtttttttttcccactcatatgtagaggaagtttggtgttgtggttaaaattatgaactctggggtaagactgatttgatttgggtatcaatctctgcctctatttgactgagtaaatttcataactaccttaaagctccgtttcatcacctttaaaatggggataataatagttcccatcacccattttactcaacaagatttatcaaaggcccaatatgtgtgagtttatgttgtaaatggtagggatgccccataagagaaaattcctatttttgacttctactgaaaggaaataagcaacatgagtaaatgtgcatgaaaaagcagtagaaacaactctgataaaataggattgggcactatattaggttcaatagtttatgaaatcctttctgcagaggatatttttaagctggggctttaagaaggaaatgagagaagagcattcaagcaaaggaaacacatatggtaacaattctgtgctaagaatgagtttgctatattcgagtaaaaggcaaaaaggccagtgagacttgagcatgatcatctaaggagaaagtcattcaggtattagacaaagacaggctcaggaactgtagagtcctgtaagccaagaaaggagatggggttttatttgaagtatgttgggagccactggaaggttgtgaggaggaagcaccatggcttgcttagtatttttttacatattacttgggatattgtgtggagaatggaatgtacaaagaaggcatgttatgaggctactgcaatagcccagatgagaaatagtagtggattagatgagggtggtacttctggagatggagacaaatgggtagtttcagagtatgttttgggggtgaagtcaacaggcttgctcatggattggatatggggagtgaaaggatgggaagaatcaagaacaaatcctaggtttttggcttgagcaactgatggatgacaacaccatttcctgagatacgagagggaggagaagcaggttttggaagtgataacaagagttgtttcttggccttgttaacagctacttcagggtattaagtagcacttgaaaatgtgaatctggagttagggggccagtcagggataaaaatataaattttggagtcattggtttataagtattgagaatggatgagatcacctaagcagagaatggagatggaaaaaagaagcttccccagaatgaatagtgtagtgcaccagtgtttagacatcagggagaagagaaatcagcaaaggagacagagaaggcatgcaaactgagctagaaagaaaaatagaatatgaagcccttagcatgctcatatatagtagcttctctataaatgttgatatattatgtgtgtttccccagaacactgagataaggagactgagagatggtccctggaagtgctggtacggaagtagaaagtgaggcaatggaaggagaggaagccagcaaagcttgtgttttcaagcaggttaccagcaaaaaactgaagctccattctgctggtgaccgctgggaaacaatatagaatatgcctcagagtagccgccccagagggtgaggacatagatgtattcatcctccaacccccatttgtcattaactgagggctgctctctggtgagtgaactcctcagcactttggggctgctctatatgggccaagaaaaagcccttaggggttgcagatgctgtttgcacaggaaacagtgtgtgcacccacagtgtgtgctagaacaggtgctgagcagatctgacagtggttcctgttatcatgtcccttacgtgactggctctcatcattatacctttcttcattgaaatattataggaacaaaggaaattccaattgataaaaatgaattattaaaacaagagagaattcaaaattcttcataatggtcataccaaaagatgtgatgaactcattgaagcatattaaccaatggctcagtaattctccttatattcttgtttgaaagtagcaataaattttaaggcatattccttgagtgccaaagacatcattaaatgtgacaccatcaaatatgaagatgaacacatataaccttgatattttgaaatactagaataagaattcataccatacagtaccttgaaatccaatgcctttctcccaaagggatcaaaggttacgcttgatgcttttcagggcaccttgtacacaggagatcacttgatcctaactcctgggatcagaacgaatgaagcgattagtgtcacaggcgaaactgaattgcttttaagcttcttatctgagcaagtgtcgatactgagatcaagacttaggtttgctaaactctgatttggtttcctcatctctctgccataatggaaatagtaaaatgtttcctagtgcttataatatgccagacactgccctaatcactttacaaaattagctaattttatcgtcaaaacaacactatggcttaagtagcattattgtcttgcttttaactactcgggcatcaagttaggaaactggttcagttcacatctcataagtacgaaagtagggattcaaacccaggcacctgcctccagctctgttctcctcagatgactcttacacagctgttacacagcttatgtggcagtaataggctgtgatcttatccctgactatatgaattacttggaaaaaatcacacacatgatgtgtttactactttttccataaatccactttaaaaatcattttaccagaggttaaaaaaaaccctcccatcagcagtcttatttataattgaaaaaatttaggttcctttttattaaatctctttcatatggtttaaaccatatggtgactaattttttatacagtctaaagtgtatacaatttgttcaatgtagttttgcctttttgtgaattcctatgctttatcattaggctgaaaagcatgcaggataccagaaatactcttaccagtaaacttccattgaaaatctggctatggaagaaaagtctgccagccagtactttgtactttggaaaggaagccatagatccagatattctccaagaaatacaggcagtggctcatgcctgtaaacccagcactttgggaggctgaggtggattgatcacttgagcccaggagtccaacaccagcctgggcaacatagtgagaccctgtctctacaaaaaaataatttaaaaattagcctggcatggtggcatgcacctgtggtcacagctacttgggaggctgaggtaggaggatcatttgagcctgggaggttgaagctgcagtgagccatgattactccatgacattccagcctgggcaatggagtgagaccctgtctcaaaacagaaagagagagagagagagagaagaaacaaagtagttactttatcactccccaaatgtaatttatcaactgtctcttcagtctcatttgctgttacctgcctgctataccaagtaactaatcataattttcaaaggaatttcaaatatgttacgtcatttgatctcagtaagatttttgatgccaggtagatctgcaagattactttcataacacaggagaatctgatattccacctttagggaaagggattgctcctggaagctctttccaactcttttcccatatggaagaattttccagtcccatttcactctgagatattattattacttttcctggctactttatattagtgactattttaaatcctactggaggggatttaaaggctcttgtgcaatcctttcatagcccatgaatttcaagaataagagttgcttaacttactggccccagaattctgtttccacttatctctatgttaaactagagccacagagaaaaattatgacccagtaatttcttctcttatttaaaatgtcaagctcctatgtcctgaaagttagtactagattttatatgtctgcattttagttttagttttgttttttatttcagatcggaagaaaatgaagtattctgttaatttaaagttacttatggcacatccctgtaatactaatcacttaaagatgtagcaatttatattttttacagtgttaattcataagtggataggactgtgaacaaatgaattaaaccgaagtccttataatttaaacattcctttttggaaagtactttaaaaataaactgacttaaatacttcctatttgaattattattttctttattcttctcatattggttctaagatatgcaattttatatagcatacgtaatagctaaatgttaaagactgaatacctgtgcttctctttaaagtctgttttgtcttctggctaaagccagattccatttaaaaaccttacagaatatgagacactattttaccattattgtttgtgtcaactgcagccagagatgagctcccgatatctctggaataatttagaagttgatgccaagtcatgattctggtcaatacagtaatttcagttttgtaaagtttatttatttaaaaaaattagttcagtgtttcattcatgatttttgtaataccacaaggaagaatagaaaaatgtaaggataagcatgagaaacaaattagttgataaattattataagcttcttataataatgtcaactcagataactctccatgtaagctgcatatgagcataaataaagttaactgtatgattaatctctactattgtgtttgcatccaagagatattaaaataaacattatggttagatagagtaaattctaaaaagctgcaaaaacatttaggttatatatttaacacatagtaatatgcctgtgtttacatcttccaattagataaatttctgataatttttgtctccttaggattttctaatgaaaatagagagcagtattttaattgtttagtatcacataattgttctagccttcatatacaatttaaaataaatggcacaaaagtgcttggtaaagcactttataaaactatatgaatttcatctgttattctgactttaacaaattatacaaatatcatagatgattataagttaaaatacagatatgctctagtagcagaatttccacataagcatgctaccgtacatactttaaaccaagaacttccatttctaatgataagattgactagactagatatgttgacaatccttttatcacgcatgaaaaacacttaatatattttatgtagtatcctcaataactgtttaagatatatgattagctggcttgaaaataaagaaattgtctaaggtcaaaggactaagtgagagctggaatctgaatacacaagggaacattgatctcctttgacctgggcaattcttaacgtctctgtgggggtaagaaccaaagcccagggcccatgcaaggtgaggagtgtttgcaactacaagctcaccatctaatggattggcggcacacattcatgcgacttatttgctcaaaaactcccaagctaaatatttactttaaggttctcttgggtgatttatagcagaaaatgagagtccttgttaaaggtacacactctcaatacaaatcacaaaataattttatgaataaagttaaaatggtcacaaactcagtatgaaaaaaagcactaaatgtacgaagaagtcaccatgatctaggatccacaaaagcagcaaaggtaggattatagtattagaatcattaggtaagaatgtaactaagtatttgcattacatttattaaaataaaagggaactaaatgttcttaagaggtgagagactataaaaaattattaaaccatttttttaggagaatcaaatagaaaattagcaaataaaataataaattttgaagagcacaacgtggatgaacaattaagacctggcaaactagaagatctaaacaattgcagcctgaagagtcaaagaggtagaaaatatgggagccagatgaagagatgtggagggtgtggtgagcagacctagcacacattcaaatgaaattccagaggaaagcatagagaaagcggaggacactggtttttgacaataaaatgggtaagaattttccagaattaatgaaagacataaatctttagtttcaggaacaccaacaaatcccaagcaggaaaaagaaaaataaatctacatctaaacacattgaggcccaatcatgctactccagagacaagactaaaattgtaaaagcagccactgagaaaggacgactcacccacatgaccaacaaccgttattagactggcaggtctctctcatggcgttagcgaaagatggaaaacattagaataaaagcttcagagtgctgggaaccacagctgtcaaaatagacttataaacccagtgaaactgtctttaaagaaggagagatacctttcaagaaattaagaacaaagaatttgctagcaacagacccttccagaaggaatttctacgttatgcacttcaagaagagaatcctaaaaggatggcacaaatatgaaaataaatagcgagaaaagaaattcatacatatatagtatatagataaatctaatataatattgactgtataaaccaataatagcatccgttcataagattcaaaaacagataaaaaaaatactggacaaaagttacatgtaagctgagaaaagggagatcaggtttaaagtgtttttttaaagatctttctattattccagaggtgaattcagattacatttaaacattgttaaattaggtatgcatgttttacataataaactctaaaataatagaaattagctgtgtattgcccaaacaggtttagcacacacacacacacacacacacacacacatgcacacacacactcacaaacacatacattaattttgcatcaaaaatattgtcttctgtaatttcaggaactattttctgctcataaccttgtaggccctacctgaatccaacaagaaaaatgtaaaaataatgctcaatcctggtaataaaagaaatcatatgtttaacaatataaagatccatcaaaaacaacactttaaagagatgaatgagactgagacctttgctggcctacctgggaggaaacgtgcctgtcctgagttcatgctgcccctataatgcaggattagagaacacatcatatttgtcctcattatagagatcgttctaatgaggaaaaaacttatgtcaccgaatctacttttctaaacagaatccacgatctcttagaagaccaggaagcccttccaacgtaccacatggtgctgacactcaatctctgcctaaatgaactcagagaactataactggtgggacatatatttagaagaaatagttatgaaaaccatagcatggtgctgccattgttatttgctaggtaggagtctgctaatagttatctccttcatgtggcttcaatttctatatgatttggggatattctaaagcactagtatttaaagtgtggtgtggggacctctggaggtcccccgggccctttcgtccaggttcatgaggtcaactctattttcatttaaatactaatgagtgatatgtgccttttttcactctctttctctcttaaatgcatggtgttttccagagggctacataacaggtgataccttaacatattgaatgcagaagcagatacgagaatccagtcgtctttttttaaaaccagacattaaagatatttgcaaagatttaaacaatgccattcttctcactaaattttttggttttgaaaacatggttatttttatatgttaatttatattcatctgtattgttaatctttacatgaattaaatattttttaaattctcgcttaatttctaatatggtaaatatctatagatataacacatagaaacacaactgtaaggtcttaatttttaagaatgtaaaggggcttctgcaaacaaaaagtttgaaaatgacttctctaatacaacagaaagggaatatttatagtccagtaagactttgaaaaggtatagagttcttaggtattttggaggagactgtggctggcgtcattttgtaatgttcctatgtagcaacatctattgggaaaaataaagcatgtgtgtatttgggggcaggtgtttctagtatttcttgggcaaactttgagtgctatgtattatctgtaatctttgtttggactttctttgtggtaaattagaaccccaaatgttttcataacttcaaccttgaactgttgttttaggatagacaccaataaatataaggggtccactgggaaggcagagagcatttttagatttatgaagggggaaaaaaatcaatagtgtccctaaggccgtgtaagtcatgagtaacacaagtattcttatgcaaagttgacaatatcatgaaacataaacctttgctttggaattttaccagaaattaaagtggcattataaaggaaagtcgatgttttagcccgtatctcaggaggaatttgtccttctgattgctttgctctgttacctcactttggctgagctctgtgaagaatttttttttcttttcccctgaaaagttaggtgacctcctcacattcttctgccttctggctcattcactttttctcccccttcaatctttgattaaagcttctaggcccctaggagttcttatttcttatacagcaagccatgcactttgtcctcttgttaaggaatgaattaataagcttaactccctctttgaagaagagtttggaatgctttcttggagaaaattaatattcaattaccaaggttgtcatctcaccaaatagaagaataaaagacatagcatagccacacttgaagataattgaaatcgaatttcagtttgtattataccttaattacccaagctttcaggggaaattcttaattcttatgtctactttcttatgaaagtgagtacatttttcctgatgcatatttataacaagactgtttaacacactgctttaaaagaacttggattgagtggttcttcttgcaatggactttggagttttagacacatcctagttacctatgaaattcatagtgtttatcttttttgacattgcataagtcctccaaaggacaataaaaataatacttctcctaattgcatcctttatattttataatattcctgtgatactttgattggtgatagtgaacaggtacataagaggcagctcagggtacttccttataggtaacccttttcctgcataggtttttaaatcacagaatatacataaacatttatgttggttaattgtatgataaaaatattttatagttaataataatttaaagatcaaacaaaaactttgtgagggcaaggagagtaagaaattgataatgtatcagtacatggagaagaattacagcatagcatagagtgtagaaaaatgaattcatagatggtaaatctacacacagataactctgggaagaattaaaatctgtgcttggcatctgcattttacatttgtttctctgggaacttggaataaacaatgaacctgcagaagcaattataaaagctttgatgcattataaaataggcaggggttttttttccccaaactggggtaaaattataaatgaagccaagtttatccaaggctgatgttgacctgtcaagctaaaatagaaccgacttgagaatccaaggacatagcattttgttggggctctagtacttatttgctgtgcaacattgagctaattgcttaacctcttaatgccttagtttccccatttgtatattgaggataatcgtgtgttctctgactacttcacaggacttttgttagaaaatatcagatactgtatgtaggcactttcaaaaatgatcttatattactgatttcaaagagttattattaagctcccttaccctctgatttctcccattctgacacatcttcttaaaaaccgtcaaagagtctgaaaacatatccctccccaccctttttttcagccaagacctcactcttacaatgtccaagaaatattttatattaaaattaacaataaggggccgggcgtggtggctcacacctgtaatcccagcactttgggaggccgaggcaggcggatcatgaggtcaggagatcaagaccatcctggctaacacagtgaaaccctgtctctactaaaaatacgaaaaaaaattagccacgtgtagtggcgggtgcctgtagtcccagctactcaggaggctgaggcaggaaaatggagtgaacctgggaggtggagcttgcagtgagccgagatcaaaccactgcactccagcctgggtaacagagtgaaactccatatcaaaaaaaacaaaaaaacaaaaaaaacaaaaacaaaaacaaaaaagcaaaaaaaaaaacaaccaataacaggaaggtactaacaactaccagagccttgttatgtcttcatccaaaaaacaactttttttttcttaatagtaactttattaaaactaaagtcttttgactccatagccaaaatgactttgataaagaaggagaaagttggagggttcacatttcccaatgttaaaacatattacaaaaatacagtagtcaaaacagcttggtactggcatgaatataggcatatagaccaatgaaatagaatttatcatccagaaataaatccatgcatctatgggccactgattttcaacaagactatcaagaccattgcatggacaaagaataatatcttcaacaaatagtactgggatgactgaatattcatatgcaaaaggatgacattgagcccttacctcataccatttacaaaaattaactcatgatagattaatgatataaatatgagctaaaactataaaacccttagaaaaaaaataggagtaagtcttcatgacttagagttggtgatggattcttacatatgacaccaacaagtaataaaagaaaaatattaatagataaattagacgttattaaaacaaaaaaagcccttttgtgcctcaaacgacactatgaagaaagtgaaaggacagcccactgaatgagagaaaatatttgcctgtcatatctgatgagtctatctagaatatataaaggacacttacaactaaacaactgaaagagaaacaatgtaagtaaaaattagacaatgaacttgaaaagacatttgtctaaagaaggtatacgaatggccaacaagcacatgaagcacatgaacaggcgtccacactgtcagtcattagggaagtgcaaatgaaaaccaaagtgaaatacctcttcacacccctgataatggcaaataataataaaaaacaagtaacaagtgttggtgagaatgcggagaaattgaatggaccctgcatactttgctggtggaaatataaagtggtgcaaccaggctggcatggtggctcatgtttgtaatcccagcactttaggaggctgaggtgggtggcttgcttgagcccaggagttcgtgaccagcctggacaatgtggcaaaaccgtgtctctattttaaaaatacaaaaattagctggacatgatggtgcatgcctgtagtctcagctacttgggaggctgaggtggaaggatcacctgatcccaggaggtggttttacagtgagccaagattgtgccactgcactccagcttggttgacagagccagactcggactcaaaataaataaataaataacaataaataaataaataaagtggtgtagctactgtggaaaagtttcgtgattcttcaatatgtaaaatgtagaattaccatatgatccagcaattctacgcctagatatagatgccaaagaactgaaaacaggtgttcaaacaaaaacttgtacacaaatgtttatagcagcaatattcataatagccaaaaggtagaaacaagcccatatatccatcatttgatgaatggataaaggaaatgtctcatatacatatgtataatggaatattatttagccataaggagaaatgaagcactaacacatgcaacaatggagatgaacctcagaaacattacactaagtgaaaaaagccagacacagaggccacaaattgtgttactccatttatataaaatattcagaataggaaaatccatagagacataaagcaaattagtgattgccagagggagacaggagtggggagtgattgcttaatgggtatgggatttccttttggagtgatgaaaatgttgtggaactagatagtggtgactgctgtacaacattgtgaaagtatactgaaagtcactggattgtatacttcaaaatggcaaagtttaaatattaaaaaacctaaagtaaacaaagtgtttttcaaatatatcagtcagtaaccaaaccaaacatccttcatgtatttacatgaagtatctccacaacaacagtgatatcattaatatcagtgataatcatagataatgataacgtactcattatgcacaaggtgctattctaagagttttgcatggatttgcccatttaatcatcatgacgactctctgaaataatcttcatatttttattttaatatgagaaaaccaagacacagaaagtttatgacttatataacatcacatacatggttaataagagatttgattctaattggtctgtttccgaagccaaagctcttacccagtacattgtattgtctctgcagcaaaaaatggaaacaaatagatacttcttggacctgatttttttattagaagatgttaagaaaattatacaacagaatctgtatcaccattgtctttttttttagaatttttaaaatatactttaagttctgggacacgtgtgcagaatgtgcaggtttgttacataggtatacacatgccatggtggtttgctgcacccatcaacccgtcacctacattaggtatttctcctaatgctatccttcccctagcccccaccacccaacaggccctggtgtgtgttgttcccctccctgtgtccatgtgttctcattgttcaactcctgcttatgcgtgagaacatgtggtgtttggttttctgtttctctgtttgtttgctgagaataatggtttccagcatcatccatgtccctgcaaaggacgtgaactcatccttttttgtggctgcagagtattccatggtgtatatgtgccacattttcttcatccagtctgtcattgatgggcatttgtgttggttccaagtctttgctattgtgaatagtgctgcagtaaacatacatgtgcatgtgtctttatagtagaatcatttataatcctttgggtatatacccagtaatgggattgctgggtcaaatggtatttctggttctagatccttgaggaatcgccacactgtcttccatgatggttgacgtaatttacactcccaccaacagtgtaaaagccttcctatttctccacatcctctccagcatctattgtttcctgactgtttaatgatcaccattctaactggcttgagatggtgtctcattgtggttttgatttgcatttctctaatgaccagtgatgatgagctttttttcatatgttcattggccacataaatgttttctttgagaagtgtctgttcatatccttcatccgctttttgatggggttgtttttttcttgtaaatttgttttagttccttgtagattctggatattagccctttgtcagatggatagatagttttctatagctaggaaaaaagtttctttggaagaactgaaagctggcctatgccagatgttaacaaaatagcaatacatgctaggagttagttgtttattatgtcctctacacagtcctcattggttttgtgtttacctctgataatagttgctatatacatatttcagaaatttgcaaactgttttgtttttctcaacatattctatcaagtgtttttttttttcatctcttgaactgagatagaaatttgagaatgaaaatggttggtttttggaattttaggagagtattttaaaagtcagtttcctgaaagctgtttaggcaaacatttataaaaggcaaaatataattaacaaagaataatttcaaaaaatattatgcaaggtaaaagatgtctaaagtctgaataaagagtattaaaacactctttccgatcataaagaacaactttggtgatataaaaaagctgtttctatttggtgatcgccttatacttcaagagggtctaatcagtcctttttgaaaccgacaccttcaatgtctcctaccctatctgaaaccaaaaaaggtaaaatgaaaattcatctcacccactagtctccagcctcttcccctccgttatttttcccctcattgaaatgtaagtgagggagggctggaactgattcttctctgtcagtgcttagaacagtacttagcaaacatagatatttgacacattttgaatgagcaaatgcacgcatacatgaataaatgaatttaccaatttctttgagtctgttatttctgcaaattatatatttatgtatatgtatatattaacatataatctatagattatatgttctttacataaaatatctactcaatccatttccaaataattttaaacatcacaaataaaattaaaagagaaataatgacataaaaaaattcacaagtatccttaatatagagtacgctattggaaaacagaagggaaaatactaatactttaatcaaattagaaaataatagaaatagatttctgctaagtataattaataaaaattttaaaagttccacgtcactaatttataaaaatacacaagtggaattaataggagataccattttcttacttaaaatatttgtaaaatctttaaatcataatgttcaattccatagaggaatgatgaagtaaggtatatcaagtgaaatatataccatcatatgctgatggctgttaggactttaaattggtatagcatttggaggaaataatttagcaatgtgaatcaatagtttcaaaaataatcttactcttgctctcataattttacttctagaattctagtatgagaaattatgatacaaatatgcaaccataaacaaaagaatgaaaaatctctttaagtactgatctagaaataactgtatattaagtggagaaagcaaaatatgtatgatgtatattgtatgctaccttttttggcaaaaaaggacaggataattacatatattcatcttcacctatatactgaaaggtaaaatataaaagattatatatattaataacaatgttacctgtggggtagatgaggtggaagtggataaataagaccatggacgggagcaagatttttcactgtctacactttgtttatataaaaacaacttataagacaaacaaaggtattatctactcaaaaattaaatattaaaaactattaatagaaaaaagtgggatttgtagaaatgcatgttttcaggttgaagggaggaaaaatatataaatgcttttgtttgtgggatgttgtcataattatgtttgggttaaaagaaaattagaaatgtacacaaatacttattggaagctagctatatacattacactgtttttttacattgactgaatattggaagcattccaaatactttgatatattcacataataaaagaccattgaagttaaaatgatgttgtaaaataatacataaaatggtattaaatatatggaaatgcattcatggtatgttaaggtagggcatggatagggaagcaaatgagatgatagtatgtaaagtaggaatctatatttttaaagtaaaaattttcaaagcatgcatacaagcttatatgtacatatagagaaagaactggaaggatattcacctattaatgatagtgcttttctcagggtagggggatgatgggtatgtttcctattatctttattctttaaagttcttcaaataaatactttatgaaacaaaaaccaaaattcctccgcttattaaaggcttagaatgggctatttattatattaagcattttgagcatagtctcttaaatttcttaaaatcacacaaggtaggtcttatgaaccattttacagatggaaaatctgaggctcagagagattgagtaacttactcaacactgcacaactagtgtaagatgcaaaactcaaacgctggtctgtctgtctccaatgctatttctctatcaccctactaaataattcaacaaaaaaaccctgcttgcaattggaaaacatttttcctactagttttctttttaagtggcaaatcttttccttggttatcagaacttacatttttgtgaagtgtgctaaaatgctcaagaattccctgacagtaatttaaattaaactatcttgcatatgtgaattatttcatgtttttttacagtagataaaatatgctaatttgtgtaaatggtcttctgggtacagatgcttacactgaaagcaagcttatcttaaaagctgcttatctttcatttgaggcttctttatatgcatagtttatttttctaatgctgtctcaatataggaataattttaaggaggtatttgtggctaaatgaaagattaaaaaaaaaccaggtctcttggctttggtaaatattaatgagctcatagaaaatcttgttactgaagtgggccctcttttgagagttttctgccatcttggccctttgtgggcccttctcctttgttggggattagcatactgggttgtgtgtgctgttgtgagttctgcttcagttcctttgtgtgtgctgacagaaggctcaccttggtctattaccagaatagtctaggcatcttaatattatattggatttctgtgagaaaaaagcaaatcatccagaaataattaatctgacttattcatttaaaagctttaacacaaaatggacagtgttcatttcggtcatttatatattgtcatcattaacaaagtaaagtccaatgtttattaattttcaagtgaggagaagttcagaatttgaattatttttatcgatattcacacatatattgtatgtgcaaaattattacagcacatacacaacttgatttaggcactctgttttcctttagaccaagcatcatgttcacttgcctacagatttctaaaaattatttttagtttcataagcagtaatattttttaattgtgttaagaactcagagaaggtaatgttggcgctattattaccacattggtcatcctctaaaaacagtgttgtgaggttggtgttagatataaattgtgaatgatgattaagtacatttactgatttcattctactatatgcaatcctgaaatatgagaataggtatatttaacttgttaggtaatttaatgaaatatatttgctgatatcattctactatatacaatcctgacattatgtaagaagaaaaaaggcaattccactattgacaggatataggaatgatcaaaattacttaacataaattttgaaaaattaaatttcccatgcatattttaacttctccattagtccaacaggttgtatgatgcttataagggaattatttggcaaagaaatattttctttttaagaatgcagtatatgagtatagtcacaaggggtcataaattcacacccagtttttttaaaatgagcccattggattaaaaaaaatcagaaaaactaaagcagttgtttgaaaactttttttaggcaagaaaaaaatgcattaagcactttcaagagttattactgtcatcatacacttcttcatcttctttcatagaagttcaatataccagacatttttactgtcatgaagagagaaaaatgatagttcaagaatataacaagagtatttggaaacacagatagaagtgtcattagcccactattaagtctgtactgaaaaacgttctttaaattttgtgctcaatcatttgaataaaggatttaagtccttttataaaaactgtttttggaagaaattttataagaatttttatcagagccaattttgagctgaggttgtggctggtaatattcagttgttgataaatggagtgtgaatcctgagagaaaccacttcaatagtttgagaaagaaggagacaatttctgaaaatgatttcctaatctgagaaacagagctttcttctgagaaaagttttaataattttaaaaactacagaaatatggagtcatggtcacatatagccatttttccatagttgtatttgtggtgagttagaaaatagatatataataaaggtctggaaatgcaaacagtcaaatttaggtttgattattattagttttgagagaaagacagagaatagtacttaatataaactatcattatgttacttctaagtatgttcctttcaattcagctgtactagtaaaattttactttttttttttaataagggttaaaatcatggttgaaatctgaagcatagacttgatatattgctttcctatgctaaggttcctagccctggacactaattctaggaaaaatattgaaaagaggaaaagagctctcaaatattaaaactgcaccataaagttcaaaagtaatataaactttattttattttattttatttttttttttgagatggagtctcactctgtcgcccaggctggagtgcagtgacgggatctcggctcactgcaagctccacctcccgggttcacgccattctcctgcctcagcctcccaagtagctgggtctacaggcgcccgccactatgcccggctaattttttgtatttttagtagagacggggtttcaccgttttagccgggatggtctcgatctcctgacctcgtgatccgcccgcctcggcctcccaaattgctgggattacaggtgtgagccaccgcgcccggcctataaactttattttaaaagcttgactggtattaagaaagcctataataaaactcaaatgtatttttttaaaagatagctaatttcttcaatgaaattcaatatgatctgaatttttacttagacacagctttccaataacatattgtggtagtaagaatgctggtccttccaagatgtccacaccctaatctctggaacctgtgaatattaccttacatggctagagggatgttatatagttgtgatgaaagttaaggaccttaagatgaggagattatcctagattatttgggtgcgcccagtctaatcatatgagtccttaaaagcagagaaccttgctgtgatttaatcagacagagatgtgcctgaaaaaaagacacagagatacaacagtgctggctttgaagatgaaggaagacgaccacaagtcaaggattatgggcagactctagtaactagaaaagacaagaaaatggtttcttcccaaatgtcccagttaacacttagtccagtgagacctgtgttggacttatgtcatacagaacaccaaaataataaatttgtgtagtttaagccactaaatttgtgttgatttgttacaagagcaatagaaaattaatacacgcgatagtaggttgaataatgtccttccatatatgtccatatcctaattcccagaacctgtgaatgtttccttaaatggcaaaatggactttgcagatgtgagtaaggactttcagatcgggagattatcttgaattgtctaggtagaactggatgtagtcttaacagtctttataatacagacacaggggtggtccaagtcagaggagagggtgataagctgatgggaccagagactgaactttgaagatggaagtaggggccacaagccaagaaaaataggcagacaccagaagctgaaaaagtcaaggaaatagatgctgttttcagagactccagaaaaaaaatcagcttgaccacacttcaactttagatcattcaaatagagtttggacttctgacttccagagcaataagataataaattcgtgttgttttaagtgattacacttgttgaaatttgttacagcagccagaatacactaatagagacacatttatgatataaagtgaggtatatatatgcaagaggctgcatgggcataggatggatttttgattctttgaatagaaattttgctataagatcatagaagctatgttttcaggtaaaacccagtttactttaaaaaaattttttaattgacgtataaaattgtatgtatttaccatgtacaacatattgtttggaagtatatgtaccttgtggaatgactaaatctagctaattaacatatatattatcttacataattatcatgtttgtggcaagaacactttacatacactgtcttagctttttttcaagtatttacatctatattaagtgaatttaactttaaaaacttacaatgtagtagcttgtgagaaaatggcggtcatagttcacatctgtattttcacacattgagtaggcccctcccacatcagctctgggttttaccagataacttactttggctgatagaacagtgtcaaaaatggctcaagcaaaggcttaagaagtgcttttgcattcgacttgctctttcttgtcgctgataccctttttcactgtctgaagaaacctgagttagccttttagaggatgagataccttgtagagaggtcccagctaaggcccctaacgtgagagttttgctgtcatagaccatcaaaccccagccaaactggtacagactggaagaactactcactcaacccacaaaatcagaagtaagaaacgtttgtttttttcagccactaagttttgggatgatgtgtttctcagcaatagataaccactgtagtgcatttattttctcaggctgtaaggtgcatttcagacatgactgttcctccagcaatcataaggaggtagcattagctatcctatattagatttcttctgaatcatttgttgcctttggtttttcagggaggtgggctagaaattggactagggacttcctgggcatcctgaaactactgaaattgagtaccttgacttgtacttttcagaaccaatttttaaaaatctttatcctccagaatatatccaactaaaaaaattaggttagaaatatttttgtaaagtattttaccctttgaatagattctgaatgaaaaggagaatgtacttcttgctaaatgtctatatttgtataggcctatatgagtatggtagaagagaggttgtctaagcagccacctaacatgttttaatgctgcggaatatcatggctgatgggtgtcctgcagaggcagtgttacagcactgaggacatgcctcagaacatttccctaggcattctaacatgttcagagatggatatcatagtggttaaggctatggctgtggatatagactttcagccatccaattctggttccgctttttactaggttatttacttcaccacatggggacaataattgtacttattcattgggttgttatgaggctttaataagttaatgtacaacatttgtaggagttgctggctggttgttagtgctcaataaatgcctctcattgtatgtaccaggcgattttacccccacccagagtctgccttgctgtagctgtgctactgtcctatgttggagaggaggtgttacctcattgggacccttcagtcaggtggttgaagtcagagctttgtagaaaagaaactaaagatccatttgcttctgatgaaaacttactaccagaaaatttcctgaaaaattaaagaatatggatgcagtccctcctggtctctcagagagctgtatattaatctctagggctctgaaggaacagtttgaagacaacttggccagataacctctgaagtccccacaccccgccccaatgctgctctcaaattaccacctcatggctactcctctcatattaggaaggtgatatttatttccatggaaaacaacaaagttaactgactcctttgggaatggaaagaatgacaatgtttccttcaccatgaactcaatcaactaaaataaccattcacgcctcccagctgctttcaacttttcactaccaggaatttccctttacctcttgacagaggaactcctgcagttatcttctcctgtgaccgctcatgtttgcaggcaaatatattctccttcagaggagctgacataaaagtattttaaatcaaaatgggatttaatatcacttgttattaaaatacatttctggtgcctgttttaagggtttattttcttgccaaatagtttagtgtaaaaggagagaaaataagtaaatcttatactatctaaggttaaaaaatttacgttttgtgatcatgatgtttgtattgagaaagtatgtgtgtgtgtctgtgtctgtgtgtatagcctgtaatgtgtaaggatatgatagaaactatatcacccacgcatttcattctattgccttcatgcttagttatttgataaataactgtatctcttatggcctaatgtaaaataatgaatcaaatttccccagtgctgaaactagtcgaggccttttgggaatacttttcaaaccattaacgcattaatgtgctgctacctatgtgtcctgaaagggttactgtaggtttcaaaaagggtctaatttactagctaatggtatttttttcgtaagagtcacttggctttgcggaatcgaatttcatctttctgcttttgggttaattcaattgaatttccagcaaactacattgtttcattctcattgcagtcagtccctcatcttacaaaccattgtgttccaaaaactcatttgttatttggttatttggaacttagaggtagttttcaatagaaaaattaaagctacaaatgttgggtgtgttcccagaatagcccacagaagccaacttaacccatcatatgtccagtcctcatgctgctatccaacaaaaccaacatgaatagcagtgcctataaaggtagcgtgctttgccagatccaagctgggagtcccagagctcattcttctatagcagccctgtcagtaggagtgagaactttcctgtcttcattcctccaacctcaaaagaagcaaagtgagaacacagcccagccataaaccatcaacagtgactgtgattgtttgggccaggggttgggggtagaattactcagggacaggggactatgtaatagagcttaagcatcaagatagaggcagaggagaatgaagagtcaaaattgtttataagttgtcaggatgtagtgaggtcttagaatgaggagtagaaagattgacaactaggtgactgggtgagtgaagacctgaaactagattagatttaaaggcttctgccaccctctcttcccctttacaatttcagagtcagctacagattcaagttcacctaagtaggattgcttggtaaagagcaggcatttcactcactggaaggctttataagaaatagctcattttttctgccattttttttgcccctgaggctcttgctcgggtggaaggagggaggccaagggagaatctcaggagagcatgggagcagattagagtggtatgatagaggttctcaggcagagacaaaaaagggatctcaatcttggtgtgcctctgctcctatctctgttgttataatgggaaaagtttgaacgtcaaatggaagagaaagtgaacttctagaagaagggatgtcaatagaggagcctctcctgcatgtctactaggacagtatccacgtgtaataaagtcaaaccaaggtggtctttctggatttggcttttctgacagtttcctgagaattgtctcaggaggaaaggatgcagttctcaaatgtttctttggaggaagccatatacctgtctaaggaaaccattataatcttagaaatgagcttttgtaccagatgtaccacatatacaagattctcataggaggatccttgatgagcctttccttctcctgtcttgagtgctcttctcccctcatttaacccagttagttcctacacgcctcttagcatgcccatgtcatgtgctcacgaaaacctttcctgaacatgtttcccagtcaggctaggccagaccctgagatagaagcacactcaaagcatattttgctgctgcttttcattatttttactctctgtcacaatttgaagtacataactcattggggaactcctttttaaatggttgtcttccccttcaagaaaccatctccatcaagacagagactatgaattaaccactgtatccagtgcctagttcagtgcctaacacttagtaggtctttgtaaatatttgtcacgaactatcaagaagcagaaattttgtatcttaacatgtctttgtagggaggtcacctttaatgcatacctttgactattaagaaacttaagtagtgcacagagaagatgtagagaactgttaaataaaataaattgacttaaatgtatcattgcttagtataagggtggactctagacagcctttatatctcaagaaatttgcctacttctatgtcaaaattgtattagtacctatgaactttccaaactagttaatgctgttttgagttgaattggctttagaaattctaaagtggagagctgcccttggcttgctgcattgagcagactacagttcttaggtaggaggcaggaatggtcctgaggaacagtcagcatctctgccatccatgcaccacggtagtctagagcaactgagaaaaccagatgcctccatagaacccacaggtgtagacattaacaataggacactgtggatctttgtgttgatttcagccacccacccaagtcattaatttatagtttatgcccttcacaaaggaaatgtttttgctaacaaatctcttatgatttcatctatttgtcttttcctctttgtgttttgtctcatacaaataatagttaacatagtgacacaaacaccactaaaatacttcagtatttttctcaggacttattcattttacctggaaggaaattgccgtataacccatgccattagaaaattaaaaatgcaaccatttctgcagctcgtacgtcatatgctatgtaatgaaaacgtgcctagcctcctactcccttgtatttgccaacagaacttaagcaagttctgtctgggctgcactcacactttcttagtgccagggagatgattggatataaattacatagcttatatttcctaatatactaaaaagaaagggaaaaacagaaaaggaaggaagtaaaggaaggaaaaaaagaaaaggaaggaaggaaggaaggatctctaagtgtgtatcaccagaagcttagagagatgatattttaactgtagaaaattctcgaagattaatctactatatcatgattctttgaacttcaaagtatacccccaaaatataatatgtgaacagttgagtactattgcatatttcagtcaaaactaaaaacaataatctgtaactgaatatgtaacttagaaaatatcaatataaattttaatctaaatgatctgtttattcctttctcaaataatgacttcattttagtaatagagtgttttatttactcatataggcatacataaatagattttaagcattatttgtgatgaggcataaacatgaatcttctaatagaaagtggtaccttggggtaaattttattagggaaagatttcacttatgtgagctatcaaagtgatcaaattcatggaaacagaaggtagaatggtaattaccaggggctaggaggatggagaaaagaagagttgtttaatgtgtacatagtttcagatctgtgggaggaaaatgttctggagatctgtttacaaaaatatgagtatacttaacacttctgaactatacacttccaaatgcttaagatggtaaattttatgttgtgtgttttaatcacaattttcaaaaagaaaagaaatattcataagaaacttgaatattcttctagttttgcaaattatccttattgtttagcctcttaattgtatatcttacaaaaatctagatttagaatacaaaattattatgtgtattttatcatataaactcatttgagatgttaaatgatttagaaacactataaaattatagacagtttgtattcactttttcaaagttagttaaaacagtgttgatgtttctctgaatattgtcatgtttcataaaaacgttaatcttcagtaatttacatttattagaataatagtgtaaaacatgttatttacgatcattaaaagttagagtgttctaaccaattattactatttattgttgttattattattattagtttgagacaggatctcactttgtcatcccagctcaagtgcagtggcacaatctgcttactgcaatctctgcctcctgggcgcaagtgatctgctcaccttagcctcctgagtaactgggactacaggtgcatgccaccacacccaaataatttttgtattttttgtagagatggggttttgccatgttgcccaggctggtgttgaactcctgggctcaagtgatctacccaactcagcctcccaaatgctgggattacgagtgtgagccaccatgcctggccgtaaccaattattttaattaatataaataatcagagtataacaaaatacaccaaaactggttatattatctttataaaatatgttttataaatcactaacaaataactaatctggttggtgataaatatgtctgcttttacttattcctctccattttagtattgtaattttttagcattctatactagatcccatgtacagttgaagttttcttttgtttgttttccctgtcaggcttttaattaaagaataataagatcttatattattatagatcttatatcgcttatataactaaagagtacattcaaccaaactttaactgaactttacttgtttcatactggtggaaataagcacaatgtgaataacacctgagactgtcactggtggagagcgctcatgagcccagccctccttgggcttccttactggcctcccagccccacccttggcctgtgccatccttaatgtgaaatcccattacaccttacctaatctctcaaatggcacctatcagatcttctcttttattcttgagtattcagttcctcccttttttttttgatctttctaactgacatgtttacagccatttaagacacacagcacatgtacacatgtaacttccctcaaatccatgtgcttcttccattactctgtctcttttcttctttgcatagcaaaactgatctgtaccaattagtgaccgacatccttaatctagcagacaggttttagtctagttttctattgtccagatgatgttgcataatcaacaatgtcaaacttcaggggcaaacaattctgaagttaaataaagcactgcctagttcttgtacctgtgagttcgctccacccttgggctctgccctgctgtctctatttcttctggaactcaatggctagacaggcgtgtccttctcatgggaagagcagaagcacaagagggcaagtggaaatgctcagatcctacatgccatcaatttttcctttttcttttggctaaaacaagtcacttgaacaaaagaaactatactccactgatttttgtgggtgaaactgcaaagtcacacagtaaagaatgtggatatatgaagaggggaagaactggggccaagaacatcatctaccataataatcttacctacctttggagtagcaatgagtactataggcttttgccttctttaggaaataccctcttcctgtggcttccataatgaaacattgtcttgatttcctcccatccctctggctgcctttgtttagtttcctttgctggtccagctttctcaagacctggtaccaccatctcctcatctttttttttttttttttttaatatggcctctctacttagtgttatccatgattctggaactcattgccacccaaataaagctgaagcagagatgcttaaattgttcccttagtttcaaaaccatatatttaattacctattttatatttcttccaagatgtttcaaagacacctcagactcaacttaagcctaaatttaaatttaaaacatttataattattccctcttgtacccccagacttcttcagtgctccctagctcagtgaatcctactacatccattgagttatagaagccaaaaaaaaataagactcatcctcaacacttcttttctcattaagctctattgattttattgcctaaatagtcctggaatgtatctgcttctttctgtcactgtggtttctccctagtctaatccaccattctctctcacctgtagcattgtattatcttctgaacctcatctccttttgcccccatctgatctgttctctgcattggagccagaaaaatcttattgaaaagcacatctaataatgtctccttccttttaaaatacttcgaggactttccattgaatggatagaggtaaaatgcctgacagacctatatgcatttttgtccctgtctcatgccatgcttaaccgtattactttgcagttccgcaaaaaacatatcatgagacacagattttgtagggcatttatttggaatatgaggccaggaagtaggagtgagggaataaggagaatgaggaaaaaacaaaataacacaagcaaaagccattgtaagagtgtatgattgagtttgcctctctagggaacggtggtctgatttcatagcacatctagaaagtctgcagattaggacccataattatatgcctgaagaataagcacctagttgcatatatccactggctccccattgtttgagggttgcactcacttgtgtttagctcccctgcatttcagagccagacacgtgcacatcctccctgtctttgcctagttaactcctatttatttttctgaacccacctcattcctgtgacagaaaacccctgcctctaaatgaagcaggttcttccagttttctcaagaccacatgcctctactatacaccatatatatcttctttgcagtgctgattgctgtgatgagtttgcattttttaatgattatttcatgaaaatctttctgccctctggactgcaagcttgagaagaccaagtttcatgtcagcttttgattttcattgccttaccagcacccaacctaggacctggtacataaaatatgttcaatatattttcaacaaatgtgtaagtataggtgtgtgtgtattaatatgtgtgcatgcatgtatatttataaagggaaactttgaatttttagagcttaaatagattactatcaatatctaaaaaggttatcatttttaattcaaatttcatattctatttttacttattgctttcttttagtgcttacatagtcgaattataccagaggcatctgtttaaaaaaagtcatacggagaaaaaacagagaactcttgctttacattatcatgatttatctgacagcttatagtattggtggcacttttctgtagaaagttatcgctaggcagttgctttaataaaacagagatttttgagttaaaatgggtaatatcagaccataaaagacaatcctttacaatcctgccttattcagtagaagtcacattcgttagtgttgagcaatttgaggacttaggtacttacaaatatatatatatatccatcccctaaaacaccatgtccaaatttttgtttcatgaactgggaactgtgacttgataacaggaaatatgtggcaaaaatagatgagtgttcagtctctggggttttatgctgatataaaataataacaaccaaaatgggaatggagaggcagatggaaatcaacaaattatttttaatgaagtaaaatacttccataaaagtaagctaccagttggaagttatcactatttaataaatgttttttatatttctagttaccatgttgtatgccagatgatccagcattaattcaacaaataatatggtacccttggcaaatagaatggtcatcatggagatggacatagtctccaccttcaccgggatggttgttattgctttatttaaaaatgcagttattttctctgaaaacatctatacagatctatcatgtcctgagctttttctaatttcttggaagggaagccaaagtagcatgcatctaattcagtctcagacctcagcttccaagagatgttattaactgtggtgaaaggattagtaaaatagtaaatggattatgagatagttgtatctgtgtcaattagtggttgctgtcaattactagttgcttatattcactttctctcatttagggagtgtggagagtagaatattaaatgtctggtgggcacagagtctcttttcatctggtagttgtcttagttatacacggggctataaactgaaaatggtgtgtaaccctttaattgaagactctggggtcctaaaataatttcctcaagaacactctggcccatagaataaacattttgaaaaatattttctttggtttattgcatatttgaaatcagataatatctgtcactccaggatctataaactcttgcatgtgggatatttttaggtaaagtgatttttttttttttttgaggaataccaaggggatagtggatttccatgaacttaaggatcacagtttttgttaagccgaatacccaacttgaacaaattttctatttttttgttgttgcttattgacagatgtgccatgaaggtgtttttaaggtctcatgaccctaaaaatggcttacgataagcaaaagtaatgtcagctttgtcctgaggggatcttgattcacttatcagctgaaaacagctgagcaatcaaagcacaggttcttccttggtggaagtgacaactctagttcagaatcttccaatctgaatctaagatcatccttagaaattagggtgggtggagaaaccagagtgatgtgtgctggagccaatactccatcagagtgggagagtccactctttcctgttgctttccccactcaggccttgggctattttagatgaggtcaccttagccatgttctcaccactccagctttgggccatctctgatgagttcacctcagccatgttctcatcattcctcctctggggcatttcggatgaggttaccatggtgggcacatttcttgcctcatgtactttagaatgccatgtatgcttttaaaatcagagacaagtgcctaacaacttcttatttatatgtttttaggttagatgtaaaatgacctgagaactgcagccctcatgagcattggctacgtgaatttttgattaataaagtctagtaaattcattgactatatagccttatctaccaagaaaagataacttaatttttgaaaggattacttagcttgctttggagagggtcaaaatttagtagaaggtgtgtcaaatgaacattattgctgaagtaagtctgaaaaattcaaaactgttgatggtgagaactgaagtgtttattatattaccctgggtacttttctatgtctattttcctttggaggaaaacatagttctaagaatctaggaggcctgtggatgtatgaaattaagaggaaataaatattctatcaataggaagaacttcaagaaaacccaaattgtccatattctgaacataacatttgttatatgtgttatactcaatttagttgcttttgtttatctgagatttctgtagctttcaaaactgatctcttaagatttactagtaatgtgagttattaaggggggcaaaatttcattaattcattctgttttctaaatactttcccttatccttgcctctctcatgcagtctttcattgtttctctcccatttattttacaagaaaataaaaaatcttactgagacttttaggccttacatgatttggcatctccagtgaccagaaacatctcctgtctcaccattgcttactaaactccgtggcttccatcaattcctaaattatgtcaagcttttttttcatatctgaatcttgctttctgttccctctttctaggttactttttatgtatgttactccttcttctggtctgagcttaatcatgtcccctcctcagaatagtattgtctgaccacttttctaaattcaacatttcatcttatttttctcacagcatctgtttattgtcttcattgcatttgacataatttatgatttgtaaaaatgtgttggcttttctccttaggtagtgagcttcatgacagtaggaaccttatgtatcctgattattaattatatccctggtactaatagttagtttgacatatgggaggttatcacaaaaattataatgtatgaatttcaactgtaaattggaagcttgtcaagccccttcatggttagtgactgacctgttttcctcaatcttgatctaatgaggctttagactactgctcctagctttatgaaaatatttctaacaaataccatgagaacaaaaaaagacaatgtttaaattctgaatcttgacaatgttatactcttttataagtgatatgctttggctctgtgtccccactcagatatcaccttaaattgtaataatcccacgtgtcaacggtgggaccaggtggagataatgtttcccccatactgttctcgtgatagtgagtgagttctcgtgggatctgacggtcttataaggggcttccccttggctcttttctcattcttctctctcctgccaccatgtgaagaatgacatgtttgcttccctttccaccatgactgtaagtttcctgaggcctccccagccatgcagaagtcaattaaacttctttccattataaattacccaatctcagatatttcttcatagccgcatgagaatggactaatataatgtttattgcaaaagatgacatttttgaattaaatatctgaaagaaaataaaggtgtcttgtagagttttgtttccttcatttgttatcctaacataatagaaataaagaagtaatacaaagttttaggaaaacatagcaaatgaataatacagttatgactttaaaaggaaatcactttcagtaacagtaaattaaaatcttaattattatatttcacttctctatagcaaattgaaaaacaaaacaagcactgtgaaacaaattagaaattcagtcgtaatactctcaaatgtactaaggaatttagaagagtaaatttcatttagtttcaaaagattaaaaagtacaactttggacaataacgttatttttcttaggtaggcattaaagaaaatagatcccatatgtctctttttaaaagactgtatctaggccctggccccggaccctacagccatcaagatgttgatgcctaagaagaaccagattgccatttatgactcctttttaaggagggagtcatggtggccaaggacatccacatgcctaagcacctggagctgtcagacaagaatgtgtccaaccttcctgtcataaaggccatgcagtctctcaagtcccgaggctacgtgaaggcacagtttgcctggagacatttctactggtaccttcccaatgagggtatccagtatctccgtgattaccttcatctgcccccggagattgtgcctgccactctatgccgtagccgtccagggactggcaggcctcggcctaaaggtctgaagggtgagtgacctgcaagactcacaagagggaaagccgacagagatacctacagacggagtgctgtgccccctggtgccgacaagaaagccgaggctgggactgggtcagcaactgaattccagtttagaggcgaatttggtcatggacatggtcggccacctcaataaatttggagagggttattttgcattgtataaacatccagccaaaaaagcttaaaaaaaaaaaagaaaaaatctaaaccctcactgatttcagatttattaaaaaaataaacacaggtaatttccattttctagtgtctcctttgctgcgtatttcttttgtttaaccagaagatcacttgtgccactagatttatagaatattaagtgttactcacttcagtatttgtaatgtcattatccattttaggataatttcaacatttgtttattctggaaagcagaagtaatctgcattcagatacaatggcaattccatgcccagaatgcttccctgagcttcacggcttattaaagcatgcagtcctgtatttccacagccatactaagtagctggattcaggcctgtgaatttggtaatgctcagtacatttcaaaacgtggactgggattgaatatttaggtaagattgacttaaagataattagttcatatattataacagatgctttaaaggagtttgtgactgagcaaatccactgggggacccatgcactgtacagcattttaatagcttcccatggagctggtttttatccagctaggctttagtgtgctgccatctccttgtgtggagaggatttgagtctcactgtggatcctatcattggaattactctaagaatatcatagaaaatactgaggatctctttaggatttcagtatcagagatacttgttctcatccttagataagtactattaaagtagtttttattaggtaaacactgcaaatcttgaaattgatcatttttttctctctttaggttggcttctataactctaagaaccaaatatgggggcccacttataattgcagtatttcatggcatgtatctctgtatgaatccacctatgctctccatcttactctcctttttctatctcctttttcaagttcatattcaattcattgtaccttgcttaattatatgctttctgttaagctgacttgcgtgcctttttgaaatgaggtagattattaattcattaattactgtatagattgcttttctggctcattgtaattttcaagtcattagcacaacaggagaatttataaggtatttttgatatgccattagacgtatcaaaactagacattgggaaggtcttacactcttcatatgcttatgtaccttatatttgagttaattttcttaaataatttctactacataggaagctgctgaaaaattttaaagagtatttgatagcataactaatctagtacaaaaattaattaataatcttggaaaagacatcattaatgtttaggtagatattccatgccatcatttgcataacaatatcacattatgctttatcttcatattcaaagagttttcaacatacaaagagattctattataaaggtgtatttataagttagtcatttagaatgcagagttcattttcatgaacaatcaagtttctaaatgacagctaggttagcccataaaacctgttttgcccatagtatataagaaataattttaatttacagtgacaaattacagaaaatattattttacatcttaaaatagaaataaaagcacaaaaattaccttattttaattttgaaggctaagacaaaaatggtataattaggaaatcaggacgtagatacgcaggttcttgtagatgctggagagaaattctgggtatctttaaagggaggaggatttattgtactgtgtgatttcactccactgtatattagttgtcccttctttttataaatatatcattaatggtaggtgcttttctgattatcaaggaggattaagttccctttcaacttaaaaattaaatgagtaacagaggagaggagcagcaaaagacagagtaagtgaattggtattcctgagataaacagatgggagctggagcagaggcatctgagtaagggaagtgcttacctgggcattggacatgggagagattttctgaggtggctctaaatgagccataaactgctgaaatcatgagggtagagaggattcatgtgttgcacagaactcccaaggggaaaataacaactgcagatgaagggatatggatcacacaggtccccacgtttcctgtcgggctgggggcagggtggagtgagggcagggagggatcccgcgtagatggcaagttctttatttccaggtggtggcaagctgggtgtttgcaatcttggaagtgcttatacttataaaactttcacttactctgggggtatctgatactataagcatacagaaatgatgcagaattttattttaagtataaagttctgagcctggggccaggtacataggaaagtattaattaattttagttcttattattttctggcatttaatacaattgtcagtggaagttattaatactcactatttattattactgaacacagtcctctaaatcatgagttaagtaaatctaaaacaaaatacagagtactgtttccccatcactctgccccagctccatttaggaccttgttccctaacatgcaccatccaccaggccttttggttctttttaaccttttagtttcccttccttcacattattctgagttatctgctatccctcccagaaagtgaacatatgccctttaattactctgcctccattcaacgttttgaacctttcctcttcttccctttaccagccaacaactacaaacttaggtctccacttattattgtcacatttttactagcaatttacaacctcagctgttcaaaatcgagccctgattcgtcaacgttactgaaactgctattatggaagtgaccaaaactctcctttgtgcagaatttaatagtcttttctctgttcttgttctctttgatttttttgcagtattgcagtatcgaggctgttagccaccttcttctggagctcctcctcattgtttctctgagacctcctcatcgcacagctcagtctattgaaatcttgccctttcaggttccatcttagatgcctcctccttattggacccttcctgattctcccagctgccctcaataccattttgtctttgcctctattggaaagtctgttttcatctttgacatatagatatttgggtattgttaagatctctgctctggattctgagaatgaggttcttgggaataggaaattgccttacatttacttactgagtaaattcccaatcaacagttgctgaggactggctttctttctccatgcaacctcctgaaacattgccattgctgtacattattaatatttgagtcacgatatctatacctgaggtttaaaagctgacgaattgctcatttgattgccagcatcataccccgactggtgagtgtgctccatttttggtgaacacagaattttatacatttatttcagtgagtttactgccccttccttcaaagtagttctcacctaaacttgttttttattcccaagatccttattatgaaatagctgtttcagctcactggtatgcgagagcaagtctaatagcactgaatcctgacactggttctgtgttccagctctcactggttcctctcctggggtgctttttctctgactgcttttttaaggccaccaatctgaaatgcagtttccatttgacagagctgtagatgagcttactctgaaaacacactacttgcccttgggtctaaggtgctcatttgtagtccccgcacataaacctaggagctccttactttgcaatctgcaggtgctcagcctattgcatattggaaagaaatgttgtcaacaatgaaaacaagtcagtaaatacttaggcattttctcactagtaaattgctgcaatctgaatcatcaccatgttctcccaattcttttcccattccatactaggtagatttatgtgacatccctgaatatggcttctgctggtggctgctacctgaggtctgttctcctgccaccctctccgctcagggcctcggctggttcacatggcctcctgctggtgaggctgatcacttccttgcctgggacccttattaactctgcaaggtatccacagccttccccaagagagattggcagtcacttttatgcccgccagggtctgtgtcatgctttcagcacaaccctccacttattccgtcatgtagcatattagggattccctcctctcgaacttatctcctctcaagtgtctatacaagctaagaagacttactcaggagtggggtcatggtgtctcttcactgagtgacagattcttctttctcagctcctttgaaatagataagagctagtagtactgactcaatttataagatggcaaaaaactaagtaaataaaaccatgccaaatcaaaaacaaaaataaaacccacctaccctgatgtcttttaaagaagccttttgatcataggattggacattctctcacttacttactgagcatttatttctcaggtgtctacttagggtaaactccgcaaaagttcctggtaatgctttgcctatgtcagtgtggaacttggcctattaaatgacaggcagacaggccaggtgcagtggctcatgcctgtaatcctggcactttgggaggctgaggtgggtagattgcttgaggccaggagtttgagaccagcctgtgcaacatgacgaaactctgtctctactgaaaatgcaaaaattagccagatgtggctgtgggcatctgtagtcccagctactggggaggctgaggcacaaaaactgcttgaacccaggaggtagaggttgcggtgagctgagattgcgccactgcactccagcatgggagacagagcaagattccgtctcaaaaaacaaacaaacaaacaaacaaaaaacataaatgacagacaggtaagctaagcacagaacaatgtcagagtgcagttaccatcgagagcaggaaaataacagagaacagagaaagggggaaatgagcttcacaggatggggttaggaccaaagaaagtgatccaggaagtggatgttaaggaatgaatgaaaatgcagagaaaaggatgtaaaggagatctttgtgatatttatgcaagtcttctgtattttcaaaactccttctaaataaaaagttaccacctcaccaggccaataaagaggaagctaagagaaaggtattcacaacatacagtatgcaaaaaaacttgtcgctcatttggtgttactagaccttcagagtcacggggaaaccctggagacaaagctggtgtacatgcagttgaatctggatggatttggatttctaaaagggaaagacagaagagttctaattaatggaatggaatgatgtgattttctttttagaaaagtttctctctgtgactttgtggaaaataggtaagaggtcagggatgcatgtgaagggaccgtgatctaggtgaaaagtgatggaaatctgtatcaaggaggtggcaatatgactgacagtaaaagaagaagttcttgagatacttagaagatggaattaatagggcttagtcactgatgggatttaagagagaaggaaaaggatttaaagatttagacttatctggccagagtgattcaaattcatagaaaaagtaacctgtgagaaggagcaggttaaaaggaagaggaagggaaccacttctgttttgagcagcctgaatctgcactgcctatcggatagctgagagacggtgtctagtggcagctgtacatctaaaacccggacttgggggaaagatcacaatataacttagagatatagatttgaaagtcattaatagatttagactgtcttaccctggaatccatgaatagtcctaaggggttcacaaacctcagatatatgtatatactttccccttgggctaaggatctgcactgagtatttccagttgccttatcccacatgcatatatgtgcatgagatcacttatatcccttctctgtcctatgtctatctatgtccccaagaggctgatgtgtttgctggcattacccgactcccttgccatttcttatggtgaggcattggcaggagatgagagggaaggagaaggaaaaggttgggatattcttttcccgccttccccacattgggtcccatttctggcagaggctgtattcctccaggactatggtcctgtccagagtcccctccttcatggagccagcactcccaagcctgcagtaacacaaggccttcagtcccagcgggtcccactttttgctcttgccgtcctcttggtgatttgacatgcttttccagttgcctgaaacctgcccatacatcatgaggagtcccttcattatggtctttgtaccatctgaggtggattgtttcttgccagattccatgtgtctttttttggtgctctagtatacacttgtgggagaaaaaaactcttacaagctatggggacggctgaccacacccacagattgtggcccgtaaactacctgtgaggaccagcaagtaccttcatggatccttatttaccctaaaacagtttctaaaatcttagtgacaagaagttgttaccagacatcccaggtgaaactgcacccagtgagtattgtaccaaattcctaggactggcctcaagtactgctgagcttagaaggggaagagaatgtgagagttcagaatctatgaatgtgtccagcataaagagggctgaatgttacagtgatgccttcaatctaacctgaatgttcttcttgtatttttgatatttattttttttctccactttttgaggtggagagggggatcaggatggatggaatatttgatagacaaggaacccaggaatttctccaccctgtccagctaaaactatactgcttggcagagttcccaagacggcactgtgcaaacaatggcagtgaactggatatccaagtgctgccttaccagctgaaccggtacctagtgttccagcaaatacttcagttcaaaacttaagcagtgcctcctgccctctttaaatttgagaatacatatcaagcacctggagtgcaggttcttacattttaagaaacagtgaccccactcattagaaaatgtgattcaattagtagcttaggctctaaccagtcagattaacaactccattctctattccctccccgctttctctttctcccctacacccatccttactctctctgaggacacacaggagttggcagaaatgggtctggtatgaggagagggctgaaagctccctgtccctggactcgcctcagcttctcttctgccatattcctgccattttttttttcctactgactctcctcgctggcacacttttttcttcctgactttttgttgaaaacgaagcattagataacctgggggacaactgaccttgtatgcctatgtttacaacatgttgccacccataggtagccaagtcagtgattcatcaggagttagtagatagggtagctagtggtggtgagaatagaaccattcacctcttttctcttccagaggaatcagggggtaagatattagggttgaaagggaccctagggatcactgggtttaattttttttaacattttcaaaacgccttagaaacctgtatttaaataaaatctttaaaataaatcaacatatgaaacaggccttgttctggatgaagtaggttggaagtctgagtccacatgaaaacaccatggctccttcccattgtcactattgcgtggaggctcctgggaaccctgaatgcttcatgaagtccacctcgaaagccttcagttatgaaaaccttatgaaaacctgctgtaccacagacttaaaggacttgctcacagaagttaaatggcctagagaattggagagcctcctaaatctaggaagcagcaccttaatccacattacattgccttcctcttctctgccccttcaaatctacaacattggattcaggatcacacagctgacaccccattcacattgccctcacacttacgattcactagaaagctgtttatctcagaagacatttttatatttaaaatggtgtgtgtgtgtgtacactgaagagtgtagtcattataggtttattctcacgggtagtcggccaattctggacagggagtgctggcttacactgttagccaatgagtatctgaccatcgcccatgctatacttccctcatttagaatggcacccctaagttatttatttactctggcatggtccttctgtctgtgattgtaactgctctggcacacggttttgactattattagctgaaaaagagaatcccagtgatagtgctggaagtgctgataaagtgaacacttggtggtaaaaggcaattttatggcagcgccaggaagaaaaagagggtcaaattcacaaagcaattagagattggtggaagtcctttgagatatgagggatataaacctcactgaagccttgtaagattaaccaataattgtatggacaatatctggaaagaaaggaaaactattgctgaggcatatctccagttaatggctattgaaagaaaaagaaaaatggttgcttatgtttgatattgaagacaacatattcaaaatgactgtgctccaaggaatccatgtaggatagattaaattagtttgtcatctcaaggagcttgttcttaaagttaagtgttgtactcatttatcagtccaggtaaggatacagtaatcaacgcaaaagaaggcaagatctcttttttcttttgtgttgtcatatactcaaaacaattttcagctctattccaagtattggcttaaacaattctgattatatcagtttaactggactataaatgatacttaaatatttcccagtaagccgttggtataacatcataccaatgactggaattttctgatcttcatggttggtcacacagttagatgtgcgaacaaacattctcgtataagagcaaaggccaggcgtggtggcttacacttgtaatcccagcactttgggaggccaaagcaggagaagtgcttgaggccaggagttcaagaccagcctaggcaacataacaagatcccatctgtaccatcaataatcaatcaataatgtatttatttattagtccaaatgaaaagaaataaacacttcatttttttaatagtacagttctattatatttttaaaatatagttgccatggtcaacagttatccagaatccgacttggtataaaaggattaatttttttttgttttttgttttttaaggaaaaacactagctggaaccaactgtgtggacagtgaaaatgatgaaagactgagagaaactttagaaatgcaagtgagggagtaaggtgctaagaggcccttagaagtcttggcagatgaaagatactgagtgtcagtttgcctgaagacaatacatatataaacagaatgggtttgactcagattccaccatttattgctgtgcccctaggaacccactcagtcttactgagcctcagtttcttctttggttaaattggggtaaccatacttgtctaatttactttctttcttttttttaaaaaaaattatattttaagttctggagtacatatgcagaacctgcaggtttgtcacataggtatacacgtgtcatggtggtttgccgcacccatcaacctgtcatctacattaggtatttctcctaatgctatccgtcctctagtcccccaccccctgacaggccccggtgtgtgattttcccctccctgtgtccatgtgttctattgttcaactcccacttataagtgagaacatgcagtgtttggttttctgttcttgtattagtttggtgagaatgatggtttccagcatcatccatgtccctgcaaggacatgaactcatccttttttatggctgcatagtattccatggtgtatatgtgccacattttcttaatccagtctatcgttgttggacattttggttggttccaagtctttgctattgtgaatactgccgcaataaacatatgtgtgcatgtgtctttatagcagcatgatttataatcctttgtgtatatacccagtaatgggatggctgggtcaaatggtatttctggttctagatccttgaggaatcaccacactgtcttccacaatggctgaagtaatttacactcccaccagcagtgtaaaagccttcctatttctccacatcctctctagcatctgttgtttcctgactttttaatgatcgccattctaatttactttctagggttgctgcaggaacccagtggaatagagtatgtgaacatttcccaggaatttgggaattgatatcagttttatttccctgttctcagttggactgtgtgtaatcttaaagacccagccagatatgaacctttccctttttaacatttttaaagtttttatgggatctctttatggtgcctaggcttgtctcaagcacgtggcctcaagcaatcctcctgcctcagccttccaaagcactgggattacaggtatgagccactgtgcccgacctttcctctttttttttgagatggagtctcgctctgttgcccaggttggagggcagtggtgtgatctcggctcactgcagcctctgcctcccgggttcaagtgattctccttcctcagcctcccatgtagctgggattacaggcctgcactactgcatccagctaatcctttgctcttttaagagagtgtttgattgcacatattcctgagtgaacagccataaagatcagaaaattccagtaacaataactttttaaccaacaccttctaaagagcaccttgaatttatttctcaataaagaagaagtaaggaggttttgaaactcaagaaaaggataaaggaatgtttgagtttgattgagaccaggagacagagtttaagataattcttaatctattattaatagtgaggccttaggcctcatttaaaaaatgacctccttatagaatatgaggtggtacccttaagacctaaccattgatgagcttacaaaaagagatatgttttcccccatcggaaagcttccctctcagtgcagtttgaaaaatgaaggtctaccccagggtagtcatccttcatgtaacattaaatattaaattaaattggttggttgtagagccagtgttttctttgaattctttagtgtaaagaggtatttcttctggaatattttctggtagtgtatcttatttctttacccacctgtgatgtagaatctcttctgtcttggcaggaagagaaatttgtactacacttatttacttttggcaaagcagttcctattttaacacctacttgaaagtgttaagacttttattttattgttgttgtgagggggatgaattatttatacaaatttctccctttaaaccagaacaatgatacactgctctgtaaatatctgttggaaaggctttcagttttaactcatcatattgtaccgcacctatcaagtcctttactgggttttgcatcagagtcaaaacactcaaaaatgattcagggttctagatgacttcttagctgtaaaataagtttgcctttttctcaccattttggtgcaaccttacatacacatctggttgagatcattttcttgaagtcaattgaaacctattggaaacacacaagacatagcacaaatattgcatttttggagtacggctatgctgtgtgtcaaaaacctaaaatcatttatttctataattgagctcaaccatatgaaaaagtattagctacaagaagcaatcagcattatttatgacagagaaaacacagaaactaattaaatgtccaatgagttacccgaggaaatgttgaaaaaattcataagaactagctatttaaaatgatgctgtaaaaatatttatttaaaatatttattgacatgaaaatcatttcatgaaattctaaataaaagaaaaagattgcaaatagtatgaatatgtgatctaattttggtattaaaatatatattatttatttaaattgttaaaaatgcatagaaaatggtatgaaaggacacatacgaaaatgtgtttatctctgggtagtggaaatctaagtagtgtttactttttttttctttttgcctatttatttactattttgtgttttggattatgctgtggtgaacatatgttacttactgcataaaaagtaagaaaaactgttcaggatgatagacccatcttcaaataggggactacaggagagggaggtggtagaaattgaccattctgtagggggaccattctgattttaggatttctctttttagctttggtaaaaataaacaaaaaataaaactatgtcttaaaatataagtataaaaactgtgtttgttctatatgtttatactgaggttcaaatagctctcgtagatttacactttttgagtgactaatctctacatttttagtctaattttttcatttgctttttgaaccaatataggtgatattcacttctagaatattttatgatgatgtctgtatcacaaaataatagttaaatgcattgcgtgctgactagatctgactagattctaggcctattctaaatacttggcatgtatttacttgcctaattctcacaatatcctataaggcaggtactattattttctctattttacatctggatgaagaacctgaagcccacaggagctaagtctttattggaagttgtaaaacctgtggtagatctgggatttgaatcaagcaggctggctccagtgccatacaaatatgtgtcacatatgctacattatattttcatatttaccaaagatgttatgatggttaattttctgtgtcaacttgactagatcatagggtgcccagatatttggttaaatgttaactcttggtggctttatgatggtgtttctggatgagattagcattggaatcagcagactgcataaagctgattgccctctccaatatgggagggcattgtctgattgactgagggcctgaatagaacaaaaatgtagaggaagggagaattcactctttctgcctgatggcttgagctggaacatcagtcttctcctgttttgactggtactagacttatatcatcagccctccagttctcagaactacactactagcttcctgggtctctagtttgtaaatggcagatggagttttttaacctccataattacggtagccaatttctattggctttgcttctatggagaaccataacacagatttgatgaatgaaaatgctcatttaaaatgaaaggaaacttcaaacaccatattataattataactataaagtaggtaatatatttttaatagaagaacaaaaacacccaaagaattttattttcacaaatagcttgtaaagaggtttaaaattttaatttgtatttttttctctttttgttaatatgtgtgtgacacattttgtatgaatgtcacaatataccataccctaaaatacatcatttttgtgccactggttaatttaatatttcttttctttgtaatatttatccaaaaatacacacacacacacacacacacacacatatatatatatatttaaacatatatgtttatacttatcctatacacacacacgttatacttatcctacacacacacacacacacacacacacatacacatatggtgtatatatgtatgtgtatatatatatgtatatgtatgtgtgtttgtgtgtgtgtaggataagtaattctttttttcttttttgtatgtaacccataaaataattagaacgtgcaaactcactctgtgttttcaaaggtccaattcattatcacctcacaccttttcaggaaagacagttatcaaaagcatctcaaatttaggctttcactgtgtaatgtcaaagttcaaaaagcaggaaaagaaatttatgcttacaaacatctcatggtgcatgacattttaaaaagcgtccgccatcctagaaagagacaataaatgtttttacactttaatctttagactgttaaaaattttcacactaatttcctttcacaggcctaaaaatgtacttttccccctctaccattttttcccttatttatatcattttatgttggcctctttcttttcactttcttccattcttttatctctttcatttttctccttctaataactttttatccatactaataatatagatgaagatagtatatgtgtattagttcattttcacacagctgataaagacatacccgagactgggaagtttatataagaaagaggtttaactggacttacagtttcatggggccagggaagcctcacaatcatggtggaaggcaagaaggaccaagtcacatgttatgtggatggcagcaggcaaagagagagcttgtgcagggaaactcccgtttttaaaaccatcagatctcctgagactcactcactatcatgagaaaagcatgggaaagacctgcccccgtgattcagtcatcttccactgagtccctcccataacacgtgggaattatgggagctacaagatgagatttcggtggggacacagagccaaaccatagcagtacacaaaaggtgttgctaaagatttttaaacataaattgacaatacttttaatgacagtgagtcagtgctatttttcaagaataaaaagagaagcaatgccagatttcccccagtgacataaaagagaaaagtagttattccagaaaagattgtattccagtttctggtaaaagaaaaactgactaaaaagtggcttaaacaattttttctctttcttcatataacaagtccaaaggtaggcaatttctggtattactttagcaactccaagacatcagggtcgaggtcagtatgattctcctgacttttccatctagtggtgaagtggttgtttcagcttcagccatcacacccacattcaaggtaggatgaaagaaatcacatttatcaggacagaaaaatggcgctagaaatcccctgcaaatttctatatgagctcactgcctcacccatgctgcagggccaattctagctgcacaaaagactgagcagtatatttttgccactaaaattgccaactgaataataaatcaggtttcccttaaaagaaaatgaaaactgaatatctgatagatgtattactagatatttctatgcaataaattctcccaaaatctagtggtaagaagcaacaaacatttactatcaagcagtttctttttctttttgaaccctttgaccaacatctcatttcccctatttcccagcccctggtaaccaccttttcactctctgcttacttgagtttgagtttttagacttcacatataaatgaaatcatatatttgtctttctctgtctaatttctttcacttagcataatgtcctgcaggttctttcatgttgtcatgttatcacaaatgggaggattttctttattatggccaaataatattctattatgtatacatatataaatggatatagaaaataggatgtgtatatatgtcacatttgcctctttcatcacaatatgcctcaagtgatagagtgactcaccaaagggcttaactcacatctaatatatagttgacttcattgtacagtaagtctgacatcaagtatggtgcctgttttaatttgctagggctgccataataaagtaccacaaactgaatggcttaaagaacagaaaatcattctcacccatattaatgtgcacacagattgaagtgtccttatgtgatgtagctatacttactttttggtgtcaaacatcttaatgtcttttttaaaactatgagtcagtgagaactaccacctgataggaaagcatatttagattctttttcaaacaaatctcattgggtctaatatataatagttttacagattgtatgtcttatctttataatatacatttacttgattactggtgtttttatcccaaagttacagttctgtttgttatcatttgatattatcatagaggaatagcctttaaagaccttggaagtagagtattactgcaaggtttgaaagaaaaacggcagcattaaagagtgtcagctcttatatgtatatgctttttaggaacataaacttagaacattaaaactcttaggtcatacttgtcaataaatgatttttttctcaacagtactttataaccttttagaaatttgccaacaggtgacaatactccctaacagtctgctagaagtgtcagagctcaggatatctgctttttaattgccatattcaaggtctaattattttctctatattggggtaagagaactgtaatgaggaagtaaaatcattaaacaccagtgagtaagggaacagagtcttcttgaattctgatgtgaattagcttccccagcagagctttggctgtggataatttctatctgaatgtctccttctcagttatttgagaggacacataaaatataaaggaagactgctcaactcttgtggtctttaaagagaagggaagacaatggattaaaaggctattattacatctagacttatagactgttaatacttaagagtttattaacctcaaagtgtcaaaatgttctataaatgagtaagatactatgtaaatcaggctacacatatgataaaagttgtcattagaataagtggcctagaaatatataatactacacagttttcatactttttgaattcatagaatttagacactcagattcctttaaaaccaattttgctgctttatttattatttatcatattgcctttcacagttattcttttctgtaattctcagctgttttagaaaactaccacaattaccaaactgtctcaaaagcaaaatttgttgctgtagctactagaaggctaagaaatcacaaacatttgattctgtaagagtctatgtgtgtgcctgagtgtatctcatgcatggttttatgataaagcatgctaaataaattgtttatatttgtgtttgtgtgtatatgtttaccacttatgaaaagaacatacccaatggcagagattgaattaagtgctttctgcatgatctcatttttccttatgacaattcttgaatgaaggtattgtacacatttattagctaacgcggtgggcttagcaagtggctgtattagtccatttgtcttgctgtaaaggaatacctgaggcggggtaatttattttaaaaacaggtttattttggctcatggttctgtagactgtataagaagcatagtggtggcatctgtttctggtgagggcttgtagaagcttacaatcatggcagatggggaaggagagcaggtatttgacatgatgagagaggaagcaagagaaagagagggagtaccatattcttttttaacaaccaattcccacgtgaactagcacagcaagaactcactcattactgaggggaggacatcaagctattcatgagggattcacccccatgtctctaacacctcccaccaggtcacaccatcaacactgggggtcacatttcaacatgcgatttggaggggacaaacatccaaactacatcagtggtttagctgggatatgaacctaggtctgcctgtctctagagaccattcatgtaagtacatagaaaccatattcttccttgccactagaaaaaaccctctagcaatttttgccaatgttgattataaaaaattttatatggacccataaagaaaagagcaaattttgagcctctctgggaactgtgaaaaaaaaagatctgtcctcatatcaacctttgacaattcaaagagcaaacagaagattgggttacttctgtgatcacactgataattccagcaggcaaatcttagtcacaacaagtccctggagtccagccaatctggctgctttgatgctaggctcagtagaactgaaccaaatgtgcgtgggaaagagaagaaccagatattgccatgactgctcatcagtcaggatttcagagactgaagaatgcagactgaacaaacctgaacccatacaggaaaaatgaacatagtaggagcaaaccatcgccctctcatacagcatagggagggattttctggagccaaagagtgggtttggggtttcgtagtccaaagtctggactcaagggaacctcagataaccagtaaaaatgatcatccatatcttgggtctcctaacaacttgacatgagtagtttaatatgttgaaacttcagtttccacccttgcaaaatgaaagttatattgttctcttccaaggctgttggtgaggttgaatgagataaggttgatgaaaggaacctcaatacagtgcctgatacacaataatgacaataattatatcataatcacagtcataatcacaataatgccctttctagccacatatggcagagacattggtgcagtggtcctcaaacatacgggtcagatttgtcgctcaagtctgtgatctaatgacatgatgaacccattagatgcctccctatcatctggatattgttccttgctttttccaagatctttttgaagatgacaatatattttcataatatttcactattttaaaagctttctgttgagcataatatacatattggaatgtgcaagtatcagttatactgcttgatgaaattttaccagctggatgtttttgtagccagtacccagttgagaaacagaacactttctccagtcactatcctcccgcaatgaagtgtaccttgggctaatagataagttttgcctattttccaaatttaaataaatagagccatatactctgtatatgtttacacctcacttcttttagtcaagataatggttgtgagattcatagattcattcatgttttgcatgtagtcatgctttgttcttttttattgctatgtaatattctattgtgtgactataccacaatttatccattttcctattgacgggcatttgattagcttccagtttggggatattatgaatagagattctataaatattcttgcacatgtctttagtgtacaaatggaagcattcttgcatgcctaggtttgggactgctaggtcatagtatgcatatgtttagcatcttttcgaaagcaagggtatcattttacatttccaccagctgtgtactgggttgttttcaatgattattgtgtgttaggaatcattcttcctgcatcacggttatttttaaagcatccacctgagaaaaatgcagctctactaagggctggttcttgtggacattagatcccaccaagatggctgagagcaggacgtgccctatgatatgtgtatgtgttagaggctggaaagctatcagaaccatgtacctctgctgctgttttatggcttcatatattttggtggcagtccttaacagctgtggatttatttttctaatgtttgcttggaaactgaaatgagtttgaaagcagcccgattcatatagaccacacaagtaagaagaagcatattagataacacaaatatgggctagagtggcgccagagaacaaaaaagaaacaactaatgattaggtaactagtggacccaggcatgaaatttagtaatatgctgtttaaacataaaaggctaagaaaaacttgtttgaaattgtagaagtgtctgacagctagtgtaaggaatgtgtgagtttccacgctgacatcctcccataccaacagcagtttcaacttatcaggtggccttcaattttagcaatgaggagaaaaatgggtaataaatatgagatcttgtgttaattcaaaccattcacaaatctctttattttagggaaagtcacgctaaaaccacaaaccagcaggaagaagtaaaactttcaataatgggttgagcatcgactgagcttgaggcctgacacgctgcattcccattttatcctcaagccaggccagttgtgtgttttcaccaacatgtttcccacagattggtcccagagatgctaagtcacttgtcccaagttccaaaagtttgtgaatgacagagccattttcaaattgaggttgagctgattcctcactgcttcatgttgcgagagagaagtaatagggaagtagtatgatttggcagtaaacagcaggcaaactataaaacattatctgatggacgacacaaacgctctttacatctctgtcattgcgccctgtccggtaggagcagctgaatgccatttggctctttcaccttctgctatctcaggaaggcaagctgagcttagacaactccgtgcctttgttgtcccctcacctcatgtctgtattcatctctgttcccttatgttgtaattttctaaccttttcccctcccatccagtggccttatctgaaaaatgaatcctcaagttgtccacagctcttcactaagacccggtctagatccaaaatgaattcagaaggctctcagccagcggggcaatgtgtggaatttatggtagtttgggggcgtaatcttagtgcagacaagtttcctttgccttgttggaatcacatcggagccatcaaattatattgcttctcaagatgcagttaaagtgatttgggatgtgctcctctggctctcccacttgaagagctttactgtgaagcttgagcttaaggtagagatgagctggtaggcccaggtgaggaaagtggttagattccttgtgacatctggaatcagtacttgactgatagagttggacagtactttcatgatcaagcattccaaacacctcatttaatgagggaagctccaaaagtcaaatccaagaatgccaagttagggaggagtaagagctagaataaaaatctctcaatgcatggtacagtcctctttgcttttttaaaaaagttattgtaatctcacagatgagtaaaattaagcaaaatgaagctagctggtttaacaaacttcattgtagcatcaaccaaaaatgtgtgagtcagcattaaattgggccagatttggggtgggagaaaaaaatggtcagatttcttccaccaaaaggcatcattagatgtcttcattccaagctcagagtgtacatacagcaatttgctgctcacagcacgtccacagcaaattatttcccttcgtcaatcagaattgtggtcgtctaatttgccattctcaatactagtcacgctttcactctgtgtaaaaattcagattttcttctctcttcttagacacatggcaccttttacctgcaaaaggtaattgcagtgactgtattgacatgtaatgatatattcacgagctaatcacatttgcatttcctccgcttgctactgaaaagctgcaaaggagtccctgtcatcatgtgtaggtcctcttccagcccagcattcacagcaggctggcaacaccaggcattcagtcagcaggtcataatgactctaccgctttctattattcaaaatggaatttaactgggaacttcatattgtattgtacacttaacccagttttcttatttgttataggtttatattgttaagcagtatggtaaaaataaaattctatttaccaaattctccttaacagatggaatgtttaataggccaataaataataggttttaaaataacttactaatctttatattctccgtattcttaatatccttcttatctactccagaccttttattttaaaactttagaatatcttaaataattaccagtcaatatttattacatcattatattctgcatttagctttattgcttatattttaacaaatgtaataaagacaatggcatatgcagcttgtagtttgttgctatgagccaggccctgtgttaagcaattagaggatctaagtgagtcctcaccttaactgtgtgaagtagatatcactgtcctctttttacagatgaagaaactgaggttcagagaggttgaatcactctttcaatgccacacttaaaaaagtggtcaaaccaggagtgatggcgagtgcctatagtcccagcaactcaaaaggctgaggtgaaagggtcacttgataccgggaattcgagtccagtttgggcaacttaagagaccttgtttcaaaaaagcaaaaacaaaaataagtggtcaaattaggatttataatcagaactatctgacattaaagtgctcttaaaagtgaaaacacgactgggcgcagtggctcacacctgtaatcccagcactttgagaggccgaggcaggcggatcacctgaggtcaggggttcgagagcagcctgaccaacatggaaaaacgccatctctacaaaaaatacaaacttagtcgggcgtggtgacgcatgccggtaatcccagctactcgggaggctgaggcaggagaatcgcttgaacctgggaggcggaggttgcagtgagcagagagcactccattgcactccagcctgggcaacaagagtgaaactccgtctcaaaaaaaaaaaaaaaaagtgaaaactcattattctgcttttgaaatggagtgacctttcttccttgttccatattcacatggaccatttcatccacaggaaaagaagaggaaattataaataccatgattcataatttaattactagtgaattgatagatagtaatgaaacaaaagtatgagataacagagaggaatgagagtggtattagtcagtcaaaatctattcagatgccagcaatggaccgttttcacaaaatctaggatctttataaaaacttttttaaagatagctgaactttattgattcaaatactaaaacttttacaaagaaacttttttagttttattttatttttaattgacaaatagtaattttatttaaggggcatacagtgatattttgatacatgtatatattgtggaatgatcaaatcacagaactagcatatctatcacttcaaatatttatgatatttttgtggtaagaacattaaacatcgtctctgtttgctgttttgaaatatacaatacattactattgactataatcactttgctgctcaatagaacaccagaacttatttttctcagctgcaactttgtatccattggccagtaatagttccccctaccccgccccacctcaaacctctggtaaccaccaatctactccctacttctatgagttcaacttttaaaagtaacttttcatggaaatctttctaaaatattctataggcatttctgtatagcatttaaacagatgacctcaggacatgacttgaaaaatccaggatttcactacgtggtggaatagctctggtccgttttcatttgtcttgagctctgctctcctgatgtttactctcatgtctgaatccacttggttcttgccttagtgacttctcttccatctagtgtgctatggaccatataacacagagttgcaaaaaaatctgtgtatggagtgattgggattctgaaggaaaaccttacagaggaaagtggtacttcagttatagctttttggggtaccagacaagttttacaattttgaaatactgatttatttatatttcacattgttcactacatataaatgcacatgtaagaaaatgatggtaaatgtacatacagaaaaattaggcatagaagtgtacaaatgagaacccatatcaaggagcttcttggcagtcaaaccaaggcaaaaagaggcagatttagttatgatttttattatcatagaagataatgtataacagccgtgaaagagctcatagaaagcttcatgtatctttttttaaaaaaattccctaagtcagagctgtgttgtagtgggctaaaatttctttttctgtttttctttttcctttttttttgagacagagtcttgctctgtcacccaggctggagtgcagtggtgatctcagctcactgcaacctccgcctcccgggttcaagtgatcctcccacctcagcctcccgagtagctgggactacagtcatgtgccaccacgcccagataatttttgcatttttagtagagatggggtttcaccatgttggccaggctggtcttgaactcctgacctcaagtgatctgcctgatttggcctcccaaagtgctgggattataggcatgagctaccgtacccagcctaagatttcttcttggtgttgctttcactaaaaaaataatcattagcagtaataacaactgaacaattatattaaaatactgtggatcaaataatgaaatagagagttatgctccctagggccttaactatctattcagaaagcaaagataaaactttatacggctagccaattcaagttagtatatgttgtcattactgaatttatgtaaattttagatataacgttctaaccccagtttttcaacttcataactaagatatgtagttgaagattcctcaaatgcttacgaggacattaacatcacccaaatcagccaaaatatgtcatataccattgaattggacacccacatctaatgactggttaatgcagatatgaaaaggccagccccttcacctcaattcctgacaactgtaaagtgtatcccagtttcagagacctccacagggttggcggaggcctggtgatgaccgcctctctgcccaacttctccctctgcccagtcctgcttccctcacttccactgtagttgttaatctcaagatcactccctaataaatttcctgattttctgtactccagtctctatcccaggtgctgcttcccctaaaaagaacatgccgcattacaggtcactttgtgcaagccactaagaacactgttcaagggaagttacagtctaatttacaagacaaggcacagcagtgcatacacaggctgaggggcaaacaaacccttcagcttctgaatgctgttacctctcagaagccagggagattgctgagagttgggggagccaaggaaggcttctcagaggaagcatcttttaaatattttcttcttccacccaaagcacctatcttggaatgtcaaatgattcaacactactacttttccatgtgcgtttgtaaaagtatataacaatttgagggatcatgttcttatgctgtaatctttctaaatcctctttctaaatcctaatgatgtgtatgaataccatagaagtagcaatagctcacaaaggcctgcaagaaggtagttgtgtttcctgcatagaaccctgttcaattgctgcctttctcttaagattatcatgtagcttttcaccttaagaaattaatatgctgtcatctgactaaataatgcttttggctgaaatactggtcccaaacatctcttattttgttgtgtctaatattttaccatctctgctcagcataacttattctcctcataatttcactttttctctgcttacactaacacgtggttttaaaggaaatattgatgattcatggtgataatagtacgtactttaatgaggttctgccattcatcatgttgttacatccatgtattataacactgaattgtagtcacctgtactggtagtcttcagtttggtttccccagaagcagactctgagattttaaggatttgagggtaggtagtttattagggaggtaactccaagtaggagagaggaaaagtgaaataaggaagaaaagcccatcaataaatgtatattatcaagccacttacaactgtgagcaagtatagcttaatccaactaaggaactctggtgacccctgtagaatatgtacctccctttcccacctaaaggcaagggatctgggctacttttacccaactattgtcagtaatctcttaagaactgttcctcttagacattaagtcctgagcactctcagtttcccaagtgcttgagcaaagtaaattcttgaagtcagagaaagctcttaggcaaaataaataaaatgcaggtactagcagtcaggcctaagggctctgagatggtaaaggcagggggatgtgggtgatgtcctgaaacatcatctacactggctaattaagagaaaacacaggattgcaatcacattgcgtagactggatattctcttcctcgctcctacagtcaatcacgccccaatttctgctgatgccatttccctgctagctctggggactccctttcctttgctgtttttgctgtcttctagccacatatgtctgctttcttgcctgttaataccccaagagttcttgcctctgagcctttgttcaggacggagcttgggtccctttgctaaaatgtgtttttaccttgtatatttctattgcagtccttctccaagctcactttctctaagatacttcacacatctttctgctatagttggtggcacttcattttagcttcattttagcacttctcataatctgaccttttattaagtcgggttcatagacatctctgtttctcactcaattgtgaatttctgaggggcaggtgctggcatgcaattactgtggtacccactccagtgcttcacatgtagtagatatttgataaatgcttgttgaattaaattgaataatttaaatccaaattaggtcagaaaaggatggtgttttaagtgggggggggggggcaccagattcagttacctggatagggaaaacatacacttgaattttctaacagcttgcactcaagctgtcattaaaattaaagtcctttattagatgctttcattgttgccgaaataatactccctgtgccttggagcagtagatgtaacagcctctcttagttataattttgtgacatcaggcatcaagcagtcgggaaattgcgagagctggtaatataactttacatatagtatatcattacaaatgagaaaacagggcctgcgggcagggatgctctgtaacatatttttctgagaagaaagaaaactcaatggaataacagtaaattctgtaaaaaacattttctccttaaaaaaagacagtgcccatttagttatcctttaataatttcaattaacttctgcatggcagcatgctaaaagaaacaaattgcctctcagtcagaaaactgtctgtctctccctgtcagtctctcatgaacacacacaaacacacacacacccacacacacacgcatgcacacaactctaagagcaatcattttaggagtctgggctgactctgaacactgctccaggaattaagggcctagactgggcaaatcactctgtttactggaagtatccaccatttcctctcctgtttcccacccatttctatgtttgcacacttgtaagctaatctaatttaaacaagaaaaaaaaagcctttaatgggatgataaccagaaaaaatgttcccattgtgtttaaatgaattcaaatgaagtcatattttgagggaaggggagagggccagtccccctgggggacttggagtcaagacagacaactgtgggtaagctttactggcaagcctctttcaatctatttcatagcttacatacccccgctcctctgatgccccagcccaaacaatgatacacagtgtgtcaggaggctgtagtagcctaaaccccaaattactgtgacttaaagtcaacgtagtattatttttgcttcttattgttgtgtttttctgtttttattttcaatctcacctgagaaggaggcagaccaggggtaatctgggagatccatgatcattagggacctagactccttttatcatctttctctctgtatttgtcttccatcttcagtgttgcctcatggtcacagatgacttgctggagcaccatcaatcacctctttgttccaggaagaaaaaagggggagcaaggaaaaaagattaaaaggacaatgcttcttcagtacatcagcagcttactttctcttggccacctctatcaaaaaacaagaatggagaacatattttgatgaaaatgcatattataaaaagaagggaagaatggctatcaagtagacaaaacacacagacatacacaatattgcttctgtcagatccttatgtggattgggttgcaaaagagtagtgacagcatgctttaagtgcctaaaaagtctctgtaaattcccagttctcttgttgatagtgtttggttcactcagagaaagatagagagagagagagagagagagagagagagagaatatgagggaagaggcctgacattttcttgagaactgaaacctttcttttaagatggcttgcctttatcaccatccgaaattctaagcactggatatttgtaccagactctaaggtaggacagcacaaatcctttgttaacatgacttggtccttaactcttaatatccctatttcttccctgagggagagtttggctgggaaggacgcaagtatcattatttttcttctgctggccaaagttgtctctttgtgcattctcagctttcaaaagaaattgagctgaatccacttttaaactctaagggattcgttatcagaaaagaaaaaaaaaaagagagagagagatttgagttggctttgaaggaagtggagactaggaggtccaaggttgaactccttgctcttaaaagcaaaaactagagtgagtcttaggattgcagtgggctctgtgcaccagtatccatagcccttggagaggaatgcccacagtcttttgttgagatgatcacctatctcttcagaatctccaatctagaatttcccatttcactttttagtaagaatataaagttggatactgggtattcagattcctgtttctgctctctctgtaccctgaggcctccaaatacgtataaagaaagaggcaatgtggcagtataacagctaagataggagtggtaacatgcctgtgggatcctcagaacagccaccactgggaaattcaaatgatcataggcaatttctaaggaggtcaaggttgcaggcttaagtcttacatgaatcatttagctctagtacattcaccagccataagctatacacataatgatgatcattgctaccaagaatttatttatttctcatttttgatctgtcatgtacaatatgatctaaatgtaatagaccatttgattcaatattaaatgcctattaaagagatggtcagtttttaagttttaataactaatttgaagcttcttcatcaatcttctctcaattgccttttatattttaaatgatcgtttttgaaaggctttgtcattgaatatattgtaacgtgtgaaaaaaaaagtgtttatactaaatgtgacttatcctcaaaggtccacagaaaagaacatctgtcattgttaaagatcatgcagcctttttcctctgcctggggaaaagttcaaagttgacagtgagttcacttgaagagatgtaatatgaagtcagagcgaaggtaagttgacaggaccaggacaagcaagataaggtttaccaaggagtcttggcccctttcatctgttccatgatctcacctgaaacaaaatccttgttctgctttatcttcctatgtatccaggagatttaagtagtaactgaagctgtctgtagagtaagtacagtagacataacaccacacctcgttttccttttcatgccggggaagccatgttcccgtgttgagactacctttagtggggactttctattcctttccagaacaccatttacaagggaagagggagcagaattattcctctttacagtgcttggaggagattcagaaggtgatcttgttcggactataccttccttaagtattatttccctgaagaaatgctgcagagtctattctgtggcattcttggaccacaggattggaagcacttgattgggaataagacagcacatttctaagatctctttactatattttggcttttttactcactataaaacatttacctagagggctttctattaaatttagtccagcccattctctgacaggtaagtccaggcatcaaaaagtgtgtattttctaaatattgaagtaccattcagcctgtgaaaaataaagcaaatttgtactgatgtggaaagatgttccagtgcatattaagcaccaagaaatgaattagatttgaaagcattcataatattatccttttttaaaagtgggagttggtagatggatgagcagacacattagggcgacttgctgcagcctctggggataagcagtgtatgcagaaactttgatagtcaatttctttattaagaaggactgtggcccggtgcggtggctcacacctgtaattccagcactttgggaggccaaggcgggcggattgcttgagtccaagagttcaagagcagcctgggcaacatgttgaaaccacatctctactaaaaatataaaatattagccaggtgtgatggtgtgcacctgtattcccagctactccggaggctaaggtgggaggatcatcagagcttaggaggttgagggtgcagtgagccgagatgtagcctccagcctggggcaaccaaagtgagatcacatctcaaaaaaaaaaaaaaaaaaaagacttttaggaaagagaacattctgattatttacttttaagtagtttgacttaaaaaccatattaacagggtttatttgaaccctggaagatagtggaccatttttattttcttctttgtactttttgtatttaaaaaaaaattcctcaaactagtggtggtgtttttttttttttttttttttttgagacagactcttgctctgtcccccaggctggagtgcggtggtgcgatctcggcttactgcaatctccgcttcctgggttgaagcaattcccctgcctcagccccctgagtagctaggattacaggcactcaccacgatgcccggctaatttttgtatttttaatagagacggggtttcaccatgttggtcaggctggtctcgaactcctgacctcaggtgatctgcctgcctcggcctcccaaagttctgggattacaggcatgagccaccacgcctggtccccgtgttatttttaaaaggtatccttgctgtaatttttctttatattaaggattctattttagacttttatatatactattctaattcatccattaaaaatttaggcctatatcgaaacctgtaaatctcttaaataattattcaaccagaaaaaaaagttaaatgcaattaaactttgccatatgtgtatgatatgcctaaactaaatggtaataaaaccatccctggttttcattagttagatatgtgtactctcagggataaaagaaagaaataagatcattttgcagcctttctttgaatccagggcagccatccaagaggccaaaaacgtaacgcctggaaaaaataaattccttttaatcttgtggattaatcaggtagtgcaaattttttttttttttttttttttttttttttttgagatggagtttcactgttgttgcccaggctggagtgcaatggcaggatctcagctcactgcaacctccgcctcccaggttcatgcgattctcctgcctcagcttcctgagtagctgagattacaggaagtagccaccatgcctggctaatttttgtatttttagtagaagcgaggtttcactatgttagccaggttgttctcgaactcctgacctcaggtgatcctcctgagttggcctcccaaagtgctgggattacaggtgtgagccactgcacccggccaggtcctgcaaattctgatgcaaacttataaaccacccaccttgatttacattaggaatataactgtatttaccttcccaacattacataaatactatgatgagaaatcaaaattaaagtgctcaaaattgaaagaaaaaatgtagttttgaaataggaaaaccatataaaaatgaaatttagattgcattttctattagaaaaatgtaaatatgtaaatgattacttaggatgctaaaatatgcttttattcacttatatgcaaacaaacctaaacaacatatctaatatgtaaataataaaaccaaaattatcttctttatttcaattggcaacttttttctccttaagtgcatattttatataaacacttcttatttgtttagaaataaaaactgcatgtaaaattcttttattcatttttatagactgcaaatatgccatagccttctgtgagctcgataaatatcaggtgataatttggttcatttaaaaaaaaaacaaatattttacagcttttgtcagattttattgctttaggccaaaggtcaatccaaggcccagggcaaagtataggtagtgtgttttttgagtaggtatacattggaaggagttgctgaaaaggattatatgtcatatttcagaggtacttccataaaagggatgataaccaagctggcctgatgagccacaattgaagttgttccgttttataaaagagtacaccatttcccacagtaggactcctcaaatgaccttcaccaaggcagaggcatattgtgctgaggcttttcagggattaattaaggggctgtgaatagtgtaggctagacataattgtatgtgttttgtgtgcttgtaaagttacctgttatgcatccccttaccttgctcatataattaaaagtagactccaaagaccaaaatttaaagcagcccctgttcactaatcgccccatggacttttgcagagatagttccgttttgggaatgaatttgtaagtggagtttagaccacaaacactcaaaataatgctttcatctgctccactggttgaagttgcccccagcggtgttgcttctcctctgtacatttcctcaattgactttcaggttacctctctgtgcgagctctgggggtgccagagaaaggcagagaaaaagagagacctaagtgcttgaggcagaacatcgacagctaccagtacgtgttctcagctgcaggtttactcagctgttccaaaggacagagaggcagggcagccgcagggtctgctctagactattctttccctttgagaaaatgccctctgaaatttcacgtggctatatgcaatatctatatttggtctagagtattataaaaacgaactagtcctacattgtacaaaaaagctaatttaataattgagagtaatttttgtttaaatatactatgttgaatcatgcatctagacatttgagcttaagttttgagactcagtatgtactgcaagactgaagaaatgtatcacatctgtgctccaacgatccctgtgtctgcagagtgcttcgtggtttaggaagtgctttcacaagcacatttttggatacttacaaaagatgtgaggtttacagaggcgttattgagatttttcagttgagaacactaacacccaggatggaatagtgggataaaaacacagctatcagtgtcaagagacatggatactgcccctggttttacccatggccttttctggatatatatatttttttctctgggcctaattttcttcatgtggaacatgagaaaatggacaaaatagctataaaattttgagcatcctgaagtgatgaccttagacatgaatcaaagactcttgaatctcattatttccatgatcccctcaagttccacgggaccctcattaccacttgtaaattcagtatctactataatgaagaaattcgtatatgtaactgtaaatcaaaactggtataataaagcctttcaaaaagcatataaacaatgtataaatatgaatacactcctattttgttaatatatacatgcatttatattatatataattatattttttacttggtaaacatttcaaattagaatattctctaattttgaaatgttaataataatccatttattgattattgttgatgttgatatcattgaaaattttacaaaatctttttatattcccaataaagaatcctatctttctcaacattatgaacatttatcttacagttacataatgtttagaattaatgtatttatctcaaaacacttgagggtttttttaatgaaagatgcattatataacttgcctcatatcatgtatcatgcatttggtatttaacttagcgaactgtttgttatcatggaatggcggccactgtttctctttttatgcaatccattagaacattggattagcactaaattattctgtattaattgtgaatataagactgttagattagttctgaattgttctgtgttacttgtggatacacacacatattttaatacagaacatatatttcttctgaatccatttctctctcctacttgaccgtagtaaacatactctgcactccagtgtcagtgccaggttatttttgttctctaagattttaattgcattcattattttgggctcagtactggttaggaatagtcttcaaagattaaagctgtttatgtggatatgaaaaatcatttggtgatctgccgaaaccctcctgttcataagaggaagcttttctgtcaaaagaaagaatcagacacataaaacagattttctcaattgatatcacagctctatagagtcattaggctaaagcacctgcaccttgaaatgctttgattgcccagtgtgctgtgaggacctgggctgtcaccttgaatgctgatattcccttcctctgagttaaagtaacatcctagatttatcaccatattggaaattcatttaccaagttgattcagtttgttttccccactcagtgttgtcctagtcagcagatgggccccttatttattagaatggtgcggtcactgaattgtatccaccaagctctgctacttttgcagtggaaatgttagcagttttatttaccaatgcaaatatttaccgagaagctaccaaataaaagttattttggattttttttaaatgtctaattgtttatgcaatcatctactcaagaaacatttactgagcacctatttttacatgattctatcttgtttgtggcaaggaatacaaaggtaaataagaggaaacagcctggtctaatggagatgagggcactggagtactaaagacatgggttacaatttttccttagtcatttattaaccatctggcattatcttctactctgtcttccctgtacttgtgtgtgtgtgtgtgtaaagtgggaagaatatatctttatcaggttatagtgtgaattagaaattaaacatatatagtattcaataaaagcatagtggcagaataaacagttcttctcagcatcatggtagtatcaataagacccggactgtgtcctcaaaggagtgtacattttgttggtgtaatttatgagatgcctaacataaaaactctccaacttattcattacatagactgatacttcattttatctccccccaccatgccccccgccagcatattttctggctcatttgtccctttagttctcttctgtgtcatccagagtccagtcaggaaacaggaatcttagcagttatttcaattgaaaaaggttaacatagggaatcgattataccggggttggaaagctacaaagccaaaaagagacctgtgagccaacagcaatcctaaggatgggggaacaaattaaaagacattcgcgttatcagattccaaaagctcgaagaaaagacccccaaaacttaggctgagacctccacccagctggggctgataactcacaggctgcaggagggtcccagtacagccatccttctcaagctgctatctctaaggtacaatgagaattgcaccgacagtgccaaaaacagtagaagatagaagatgaggctgactgctgctgctggagggaagagctatggccggggcttctctgacagtaatgatgggtgaaaaaggaaggagtaggtcttctcctgcctgccagtttcataccagtgtcctatggcagaatctaacagggagccagctgtgaagaggaggtgtagcttcatggtcccaggtgcagcatcacagagccaggaatagaaagggattggggcttacttactaactagcacaggtctgttttagcagggtgactttatgtccagatttgcaggattacaatttaccctcaaagactggagaactcactggctcctttcatttcgtctactatgatatgttcacttttgaagagaccccaatccacatgaatgttgaaagtaaacatttgtagttatatactcaaattatcttttgaaaagaatggatctgacttttcctacttactatgtcaccattgaagactaccttctcaaaagacttctgttgttactttaaaattcttaaaagacaaatcttcatgtaattctgttggtatcaacaagggaaacacctaatgtgggaaattaacttgtcattcttctccagttaaaatggttagaaatatgaccattaccattaggaaattgtatatgaggttaaacatttattaaatgcaaacacttttccaataaatttaaaataagagatatttctcgttttttttctggtttcaactgaaatagaagatgacatagcctctgtaagaagatgtagaagatgaattttggtatttacaagtttgcatgttgttgaataaaggtttatattaggtttcataattaattctaatattcaaatatctgtttgtagagcattttaattagtttaacaaatgtttactggggtcttataagtgccaggcactgaggaatcaaagttaacaagaccgccaaggtctcagcatgcagggagcacatattctagtggagacaagtagaaaaacagcaattaaacacagaaacaatgtaaaagtgcacaaagggaaaaaaactgagttattttggggagtgtgtttgtataagtagccatgaaagtcttcttgaacagatgctatttaagatgagaactgaaggctgaaaaggaaggaggaggaggtacctatgtgaaatacagaggaaataggaaagacaccattccttaagcagaatacaacttggcattttcaagataccgccatagaagctactggagccaatgcacagggagaggagagagaatgagtttgaagggattggaggggccagaccgtgaaggaccttgtagggcccagtaaacagttgggattttattccaaccaaaatgggaaaccatggaatgttttaaatctgggagtcatgaaagctgatttatagttttaaaagtcactctgttgactgcagagaatggattttagaggttagaatagaaacagagagagtatgaggagaagaaagccaggatctagggaagagataaagatggtggtttgagatacacttcagaagtgaatcttgaaggactagcgagtaacttggacatgagcatgggtaggaaaatgggagtggggaaaggatttacgaatgcttcctatggattagaataagcaactgggtagatgttgatgtcattatgaatctggtagaaacaaagagaggaatagatacctgaaagagtggaagaaaagtgaatcttattttagacacataggatgtttgagacatctgtgaaatattcaagtgcaaatattaaatagacagttgaatatccaagtttggaaattacagcaggaggcaaggccagtgataggaattagtaagttatttatttttgttttcgtttttttaaaaatcatcaaccatgtatctggatatgttcacttgcagagagaatctgcatagtaaagagaacatccagcattgtaaagactggaatagtaggagtgacaaataaattcagcagagaggtcagaaggaaagcaggagtcaagtcctgtgaaaaccaggagagacgattggtgcatgaataaaggagccaagtgtatcttgtgggagccaatcgaacttgcagagaagtccaagtagatcaagagacagaagtgtccattagatttggccacatggagatttccattgaccttgacatgaacagttccacattatatgaagttttatgagcctatatatattcagtttttatgagcctcaggtggttgataggaaggaataataatcacgacaacttttgtcaagtctgaggaagaactgtctgctgacttatcacattttcaattaggggataatatttgatgtaagtggctctgaaaggttttctgtctcctctctgattggaatccataacttgaaattgatccagtgtggtaacaagaatgctattctcctgtttgatctcttaggctttttcactgtagggcattcgctgaaaatgatgaccaagaattgtttaagtgcaaccaggctgggaaagccagtagtaaccaccgtaggacagacaagaggtacttcatctgaataaccataagaatgatagagcaatgtttttttcactcaatgtcaatttaaattacttgaactaaaaagtgaaatatagtttacttattcgaggatactctatagcagacaatctaatgtctgtggatgttattgaattacttccttatcggagggcaagctgaatttgtctgcagttattttcgtttataagagtacagcatttattttttcttaactgtgctcgactttttgttttgatggcaaaaagcattacttggaatgctgaattttaagtatagaattgtgcccttcatattctcacatacataactttgctttaccacatagagacctgatatgtatacatagctttaatatatatcttgtgtattcagctttaccaaatttgtgaacttttcttattttaaatctggttttaaaatttttgaaggggcattctagtgttgctttctcccaacaaaccccagactgatgccttaaaaatttgtctcaagttacatatagaccacactttctcaacattttctcttagatatctcagatctaagatgtctggaacaagctcacactctttcttccataagccccctcctcttccattgtttcttatcacaatgtatagtatcaatgaggaggtgaagccaaaaatctcgattttatactctcccttgctaccataagcaattcattatcacagtctgtccgtgttactctcgcatctccttctctgtattcattgacttgacccctgctgagcccaaactaccatcactattcacctagactgttgcgatatccttctaaatggtctctatgtatttctttcaacccatttcctagaccgcagtcagaatgccgttttcaaaatccaaatcaagcatatcattcctccacttagtactcttcaatgaccggccattgcctttgggatcatgaccaaaattcttaacccagtctaccaagcttgcatgatctggctcctgcagttctctcctggctcaccttgtagcactctgtccccactctctctctccattactctgctccagacatactggccttcctttctggactatgccaagccccttcaccctcagcgcctttgtgcctgctgtcccatctgctaaggatgctcttcctctccgttctttctcacctagttaatgcttatttctacttttgactcctactcaaatgacatttcctcatgaagtcttccccaagccccgggttcagccctatccctttgtagcactggctgctttctttcacagcacatatagctgtagatttttattcctgcactgggatatgggctatgaaggatattttattaacatttgtttctaattgtacactaccaattccatggggacctggatgatgcctgctttacttgacctttgtattcccagtgcgtattgccagtagcgtaagagtgttcactaagcatttattgctggatgaatgaatgaatgaatgaatggtgtcgagaggactgcggagaaacataaggctgactctgcatcttattaccaagactggaaaaaacaatttaaagttcatatcctactgtgttaatagaactttctgtgtatgcaaaggtcagtacattttaagattaaagttgattttctatgaacttactatatatagattgaggtgtaattaataatgtcaggctatggggctctatggacaagtaattattttcagatatgttctacagcatttattattgttaccatcgataactgtaatagctagcattagtagcttgcaaaacccactcataaacctgatttcatttactttaaatggatttagtgtaaaattcaattggaaacagtgcttaagatatagatttgaggtaaatttaactttactataaatatactgaacaaaagtctaatttttttccctgtgtttttaaagtttcaatttttctataatttctcaacatggatttgtcttgataattttgcagcacaggtctggtttgggaagatcattgcttttctatttgtagctgaagtctctgccagaaaaaagtattcatcatgtgtgtaacatggtatgattggcagttatataattgatcagagagagactttttttgtctcatcactggatttcataagttgatggaaccttaatggttgtgtagctgctacccatatttcattagtgcatactacattatggacacacagtaaatattaactgtgttaattcaaatgtaatttataatttaggaagtaaattgatttctgtgtctttctgacaaatcctttcatttctttgaagtattgtttattttagtttgatgtataaatacagccacataaacaagaaaaggtaactctgtcaccttatgttttaataactttgaaataatgagacatttataagtatgctgagattttcctccaagttaatttttcattgtgatttgttttaaatctttctactaaaaactatcatattcagattttgtatgatgcaagaatgtgataatataaatcgggacagatttttctggagtaaaattcaactgtatatattgaaatatataacagttgtatacagtgaatatatattgaaatgtaacagttaatttaacattatttatgatatcttttaacattcttcctaacatacatttcctcttttagaaatttacctaaagtaaatcgttagagaaggggcccttgtagaattataaaaaaagttatgaaatacaataacttaatactattttatcctataaagatttcttatttgtataaatatacttctgatgagattttgattttgaagaaattaagtcatttttccctttgtatcccaaatcaacttgatgaagcccttacttattaacattttaatttgagaaatcccagcacaatcttactattaaaataataagagatagtaattttgattgtcattgtgacctttttaaacaggagctaaagcacaccaattggatagtttatgcaaattgtaatgttttcttttaagaaagtgcttaaaattatgtttcaaaggtttttatactcactttaatcttagcatagatgatgttgagttctgcattaacgaggaaagtatcaccttaattatgtaatagggtaacataacatcattagataaaggcaaaaataggcatggcattgccgctaatgtgtttaagtttaaaataataatttagatgtctttgtgtgtttccttagaagttgctctgaggagatagtatgctctgcttcttggccagcttctggggaggactggctctcacattaagtatattaggtaacagtacaaagcaccaggacacatctatataattgcagagaccttacttgctgggttggaatctcacttggggccctgtttgttgatatatttgcaacaaaaagccattaacttacagggtcaagggttaatggaagaaatattcttgtcttcctattatcttgcaacgttttgctgggagctgaagaaagataacgcttttctctcccagtttctcctggcagttttaaaaatggtgacttcttgtttctgtgactaaataaaagattagatgccaatatggaaagctttagaattgtactcagtcaagctgacagttcagacaagtgttccatcacgaccacctttgctgaggtcactggatggtcccagtcacagaaactaggaggaaggcacctaaataatttcttgatttctatgacttcagttttttttttttcctgctccattttaggtaagttagtcatcttgcacaagaaggcgagaaaatttcataaaactttaaaggagagaacaaaaactactgctaagtccaaaaggaattctatgtctaaaagagagaatttagctaatcagattggtgcccctcaaattccaattattttagagtgtataaagagagtgaaataaatccttgtcccaaagaaattcttattcattaaaactatgttgatgattttaaatggaattatggattaaattagtttgcccagattttatgggtgaaaatcattgcctaccaaaggttatttctgtcatttttaaaaatacattacatagactaactgtttcattataacgtatctgatgagagtaggttgcccaatgcaatttaagagtcagtggaaggtcttttcttatatgtaagcgttccactgggaaattttttccggaaattccaccaattaggggattctccaggttaattaaaataagtcctttcaggttataataaaaatatcgctgagtactttagggaacttgtgaactcctttctgtttgaaggccggaatacctttataatttcatccggaggttagtcgtagccatgggtatagttaccactccagaattgtcttgaattgaaaaaatctcagcctatttaattgtagtgctctgccaacaaacacaggttgtgctggtttgatttgacacagcttggatggtgggtttgactaattttcctaattaaatctgccacaacagtcaatgcatgtggacacatatggttacagtcctccatttcacccataatttagcttgacaacacacatgtgagttttctctttactcaatgtttatacaaagggactttttagcacataattttctaattttcctgaaattctaacttcaaaataatacaagggagaaaatggaatcacaagtctgcttaatttaaaatgaagctggtggaaaacttttccctaattgggatatttgttttcttcccaaattagttgagatcatgctttatagcaggttagccagcatggctgataggctgataagccgtttcccctgcgcccctcagcagtgacagcgtgcttctctacagaaaagctactctgtgtctttgcaaaatgacccaagcctcagtcccttaagtccgtggaccataatcattagaccaatttgtccacttagcatctcatgtagtcaaagggcagattttgtatattcatttgtgcagactttgtatattcatacacctgttaaagatttcagcgttaatgtttttccccagagatttttttaagaccttcttctgtaatctgtttattttacatattctcacaccaggagttttttatacagtaatagctacaatggcaatatatattgaccttctgctaaggcatgtttctaaaatatctctcatcagaaaaaccaagcatatttggagtttccagggagagttttatgtatgctcaccagtaacctagtcaactgtgcagactgctgctatatggtggttactgttttggcttcatctgtggtgctagggtgactgaacttgatgatctctaatagccattccaactggacacctctactgttctatgaaaaaggaaagtgaaaggcaaaagcagaaatgcaggcaattgattaacaccgagcatcactgtactttcctttcacggcttccagtcctatttttctgattgttttcgttttgactttccaaaagatgaaattgtagaaacctctctcttaagtttcatccagaaaaggtacagggggtcaatatcagtgactttgaggacttcaacataattaattctagaaacatcaggaacatagcagaatttaattatatatgtctttatcaaattacagaacttgagtgtggctggcaagggcatctcggcccatcatcaaatgtgatgtcgcatgtgctgaactgagtggtgtgcctgcagaagaagcctgagacagcatgcctgagtttctttttaatgcatgatcatatgagcacctgctctactgtgcaaactgtttctaaccatagaaggcaggaatctagttcactagtgggagaattctgaggtaaaaattggagtgaagaaacttggatatggttttcacatgcttctgaacatctttacattaattgagtttttcttttatggctaaacgcttttattaaaggaagacttaaagatctagaatgacttgtcattgttaaattttcccttctgctatatagtttcagaaggaagttcagaagcattaaaactgtccctcttcttagcacacactgttgatacatgtgcttacacattcagtcacacatacgcaattatttcttttaatttagacatatctagtgtacatgctgagtgtgcctataagtgttaattataacaatatttttgaaataaaaatatataatatgcataccttctatgaagtaaataatgatgaggcaaaataataattgttccatctgatatcttcgtaaatttgtattacaaatgattatctctcgtgtgtctctgtctttggatctcatttctttgtatttctcttaacaagcacacacatacacacatacacacacacacacacacacacacacatccttggtgatttcaaaagaaataattggttttacagtttgtatctgcaaaagatttttttttcagttagaatatctcatttttaatgatagtattagagatatgcctaccattggcattctactatgattcaattttttattagtcatctttcacccgttgcttaacgtcaatggctctttcattcttagaccctgagttgaaatgaatttttacatatactcaatatggtttggggcccaccagttcccactacagtggtgctccccatcactcacatacaattttatttaagacaaaacagcagctccagcagaaaataagtgtaatcttctcctttgtaagttgtaattgaggttatggcacagcatattgcctgtggcagaatctattaccaagaagtggagaccatgatttgaagctggctgcagtgtaagcaaaatgaattaattatcagcagtacagaattgaagggaaatacagggtttcctaaagtgaaatatattggcatttttaaatagagaacactcactgcaaggaacttattgatgaatcaccaagtcttttctacttttcttgcctttcagaatttgtatatactcaggttaagatgactatgtgtaaattaaatcacactttgctcagaatgcatagaaatattttatagtatattttgttctttttcttagttgttgaaatggagtctcactctgttgcccaggctggagttcaatggtgcaatctcggctcactgcaacctctgcctcctgggttcaagtgattctccagcctcagcctcccgagtagctgggattacaggtgtgcaccaccacacctggctaatttttatatttttagtagagacggggtttcactacattgaccaggctggtctggaacccctgacctcaggcgattcacccaccttggcctcccaaagtgctgggattacaggcgtgagccacggcacctggcctgttctttattaatttaaagtttgcctatttttaacatataactgttactgtcacttggacaggtaaatgggcaaataatgaatggactaaattagcttcagtattattctttaatagaaaaataactctctccttatcaagtgtggctcaaagaaggcaaaatggaacgttttttgagagtttataaacatttataattttacgtcataagttgtgaactttagtgaccataacttttgttggtaattatttagcaaaattgagtatcttcatagcagcaagataattagcttatttgtatttctttatgtgtggttttccatttaatttaaatttcattcagttgactaacaatgatttttcacttttaaatatcaccattcaaaaaccaaatacaattacattttgccaaatttatttttaatttttttttctaggaataggtcgttatttggctgtttttatttttctgtttttagataattgtttcatataattgtaatgaaactgtttgcttttaagcttcatttagattcttttgtgaaaggatgctctgtctctactgggtattttctagcagttgtgcacattgacttttctttaagttgtagaggatctgagcagatggttttctcagcatctagacaaatagcatacatggttcaaggtcactccatgcaacctgcctatgataaattgggaatccagaatttgtctcatttacaaatgtccaacaacataggtccatggaaaacagtgaagtgccaaagaaaaagatcagcctcctgggaaggaggagacccatggaaaatccccctagtttcagaggctttcatgtgagagggctgtactgacctgtggtggggtcttctgatagtgcttctcccttctacctgccgttcagatgctctgaactgatgacctccatggaaactacaattaccaggaaagcctcctgttgccgtggtcactagtgactgtgcccatgctaatctttcccaatttcctttccagttgttttctagggatttctgtctttgatagaatgtaagagaagagatgaagaggtgtccaggtgtgtgtgtgtgtgtgcttttgtgtgtgtgtgtgtgagagagagagagagagagacagagagagagaaatgttgatgatgggtagtgaggtaaattctggtgcctcaacaatgagtttctacacagaaaaccacagttattaagttgatgtctgtggagctctatgaagtctttatgtgagcttcagtgggtccgtggatcctctaatattttgtgtgcatgcatatatgcctttttaggggagagagttcattgcttctaccagattctcaaagggaaatatgaaatttctcccaagaaaatcctacctcctgtggtataatggttgcccaaaatgttggttgctggatgctttctacttccttaaggaaaagttaagacgttttgtacctactttcaggcagtcctggcatgtatgggccatggattgaacattagaattcagtttaattgatcttacatttagagaaatttttccctagcctctggcaatgatttggctgttatcctttttacttattttcttttttacctctatttttccccagttttgtatttaggaccaggagaagacagttctatgagtaaccagctagacaccatattaaaagtagtctgttcatattaaatattgatcacatgaatgattgtaataatcatacatgcttaaagctgtatgtgcattaaccaaacctgtgtaaaaatttagcgaagctctgaaaggttaaagaatttgccaaaaaagacacagctggggagtaacagagccagggttcaaatctaggtctctgattttaaactccatgttctcaacactatgctattatgccagccatagtgggtgaacaaagcccaccagttttcacactctatccatacgtctaacaagactcatcttccgaacatttttttttcctctcctggcttttaagagcaatggcttagctagaaaaaagtgaaccctagcaagtgtttgctacccagttcacaaaggtaagaatttcaggttgtctgttaggtttaggttttcatagatagtcagatcctgaccactttctcttgtgtgacctcagacacataatctggcatctctttgcttctgttcctttgtgtctaaagtggggtcattgtgaagattcgatgagtttatacagataaagcattaaaaatagtgcctggtacatagtaagcactcactaaaagatagctgtcattattagttataacttagttggaaggtcttatttcctgagggcatctggtacgtctttggataaatgtggccatgaaaatgacagtgactcgaagagggccgaataggatcagctcagatctggagctcccagtgagaccaatgtagaaggcaggtgatttctgcatttccaactgaggtacccggttgatctcactgggactggttagacagtgggtgcagcccatggagggcgaccagaagcagggtggggcgttgcctcactgaagaagcacaaggggttggggaactctctcctctagccaagggaagtcttgagggacggtgctatccagcccagatactatgcttttcccatagtcttcacaacccacagaccaggagattacctcaggtgcctataccaccagggccctgggtttcaagccctaaactgggcggctgtttgggcacacatcaagctagctgcaggaattttctttttgtaccccactggcacctggaatgccagtgagactgaaccattcactcccctggaaagggggctgaagccagggagccaagtggtcttgctcagtggatcccacccccacggagaccagcaagctaatatccactggcttgaaattcttgctgccagcacaatagtctgaagttgacctgggatgctcgagcttggtgggggaggggcatccatcattactgaggcttgagtaggcggttttccccttcacactgtaaacaaagctgctgggaagttcgaactgggcagggcccaccgcagcactgcatagctgctgtagccagactgcctctctagatttctcctctctgggcagggcatctctgaaataaaggcagcagccccagccaggggcttatagataaaactctcatctccctgggacagagcacctgggagaaggagtggctgtaggcacagctttagcagacttaaacgttccttcctgcctgctctgaagagagtagcagatctcccagcacagtgctggagctctgccaagggacagactgcctcctcaagtgtgtccctgtcccctgtgcctcccaacggggagacacctcccagcaggggttgacagacacctcacacaggagagctctggctggcgtctagcaggtgcccctctgggacaaagcttccagaggaaggagcaggcagcaatctttactgttctgcagcctctgctggtaatatccaggcaaagaaggcctggagtctaacccaaaaaactccagaagacctacagaagaggggcctgactgttagaaggaaactaacaaacagaaagcaatatcatcaacatcaacaaaaaggatgaccatgcaaaaactccatccaaaggtcaccaacagcaaaggccaaaggtagataaacccacgaagatgaggaaaaacgagtgccaaaaggtgaaaattccaaaaaccacaatgcctcttctcctccaaaggatcagaactccttgccaataagggaacaaagctggatggaaaatgaatttgacaaattgacagaagtaggcttcagaaggtgagtaataacaaattcctctgagctaaaggagcatgtcctaacccaatggaaggaagctaagaaccttgataaaaggttagaggaacggctaagtagaataaccagtgtagagaagaacataaatgacctgatggagatgaaaaacacagcacaagaactttgtgaagcatacacaagtatcaatagctgaatcaataaagcagaagaaaggatatcagagattgaagatcaacttaatgaaataaagtgtgaagacaagattagagaaaaaaacaatgagaaaaaatgaacaaatcctctaagaaatatggaactatctgaaaagaccaaacctacgattgattggtgtacctgaaagtgatggggagaatggaaccaagttggaaaacacacttcaggatattatccaggagaacttccccaaccgagcaagacaggccaacattcaaattcaggaaatacagagaacattgcaaagatactcctcaagaagagtaacataattgtcagattcaccaaggttgaaatgaaggaaaaaatgttaagggcagccagagagaaaggtcgggttacccacaaagggaagcccatcagactaacagtggatctctcagcagaaactctacaatacagaagagagtgggggttgatattcaaaatttttaaagaaaataattttcaacccagaattttatatccagccaaactaagcttcataagtgaagaagaaataaaatcctttacagacaagcacatgctgagggattttgtcaccaccagacctgccttacaagagctcctgaaggaagcactaaatatggaaaggaaaaaccagtaccagccactgcaaaaacaacccaaaatgtaaagactattgacactatgaagaaactgcataaactaatgggcaaaataaccagctagcatgataatgacaggatcaaattcacacataacaatattaatcttaaatgtaaacaggctaaatgccccaattaaaagatataaactagcaaattggataaagagtcaagacccatcattgtgctatattcaggagacccatctcatgtgcaaagacacacataggctcaaaataaagggatggagcaagatttaccaagaaaatggaaagaaaaaaaaaaaagcaggggttgtaatcccagtttctgataaaagagactttaaaccagcaaagatcaaaaaagacaaagaagggcattacataatggtaaagggatcaatgcaacaagaagagctaactatcctaaatatatatgcacccaatacaggagcacccagattcataaagcaagttcttagagacctacaaagagacttagactcctacacaataatagtgggagactttaacaccccactgtcaatattagatcaacgagacagaaaattaacaaggatattcaggacttgaactcagctctggaccaagtggacctaatagacatctacagaattctccaccccaaatcaacagaatatacattcttctcagtaccacatagcacttattctaaaatcaaccgcataattggaagtaaaacactcctcagcaaaggcaaaagaacagaaattataacaaacagtttctcagaccacagtgcaatcaaattagaattcaggattaagaaactcactcaaaaccacacaattacatggaaactgaacaatctgcttctgaatgactactgggtaaataacgaaattaaggcagaaataaataagttctttgaaaccaatgagaacaaagatacagcataccagaatctctgggacacagctaaaacagtgtttagagggaaatttatagcactaaatgcccacaagagaaagcaggaaacacctaaaattgacaccctaacatcacaattaaaagaactagagaagcaagagcaaacaaattcaaaagctagcagaagacaagaaataaccaagatcagagcagaaatgaaggagaaagagacacaaaaaaactcttcaaaaaaatcaatgaatccaggagctcatttttttgaaaagattaacaaaatagactgctagccagactaaaaaagaagaaaagagagaagaatcaaatagacacaatgaaaaacaataaaggggatatcaccagtgatcccacagaaatacgaactaccattagagaatagtataaacacctctatgcaaataaactagaaaatctagaagaaatggataaattcctggacacatacactgcccccgcaagattaaaccaggaagaatttgaatccctgaatagaccaatatgaagttctgaaattgaggcaataattaatagcctaccaaccaaaaaaaggcccaggaccagacagattcacagctgaattctaccagaggtacaaagaggagccggtaccattccttctgaaactattccaaacaatagaaaaagaaagtctcctccctaagtcattgtataaggccagcatcatcctgataccaaaacctggcagagacacaacaacgacaaaataatttcaggccaatatccctgatgaactttgatgcgaaaatcctcaataaaatactggcaaaccaaatccaacagcatatcaaaaaacttatccaccatgatcaagtcggcttcatccctgggatgcaaggctggttcaacatatgaaaatcaataaacgtaatccatcacataaacagaaccattgacaaaaaccacatgattatctcaatagatacaggaaaagcctttgataaaattcaacaccccttcatgctaaaaactctcaataaactagatattgatggaatgtatctcaaaataataagagctatttatgaaaaacccacagccaatatcatactgaatgaacaaaagctggaagcattcccttcgaaaactggcacaagacaaggatgccctctctcaccactcctattcaacatagtattggaagttctggccagggcagtgagacaagagaaagaaatgaagggtattcaaataggaagagaggaagtcaaattatctctgtttgcagatgacatgattgtatatttagaaaaccccatcgtcagcccaaaaactccttaagctgataaggaacttcagcaaagtctcaggatacaaaatcaacatgaaaaaatcacaggcattcctatacaccaatagtagacaaacagagagccaattcacgagcaaactcccattcacaattgctacgaagagaataaaatacctagaaatacaacttacaagggatgtgaaggacctcttcaaggagaactacaaaccactgctcaaggaaataagagaggacacaaacaaatggaaaaacatttcatgctcatggataggaagaatcaatatcatgaaaatggccatactgcccaaagtaatttatagattcaatgctattcccatgaagctaccattggctttcttcacagaattagaaaaactactttaaatttcatatggaaacaaaaaagagcccatatagccaagtcaatcctaagcaaaaagaacgaagctggtggcatcacattacctgacttcaaagtatactacaaggctaccgtaaccaaaacagcatggtactggtaccaaaacagatatatagaccaatgaaacagaacataggcctcagaaataacaccacacatctacaaccacctgatctttcacaaacctcacaaaaacaagcaatggggaaaggattccctatttaataaatggtgttgggaaaactggctagctgtatgcagaaaactgaaactggaccccttccttacaccttttacaaaatcaactcaagatggattaaagatttaaatgtaaaccataaaaagccctagaggaaaacctaggcaatatcattcaggacataggcatgggcaaagacttcatgactaaagcaccaaaagcaatggcaacaaaagccaaaattgacaaatgggatctaattgaactaaagagcttctgcacagcaaaagaaactattatcagagtgaccaggcaacctacagaataggagaaaagttttgcaatccatccatctgacaaagggctaatatccagagtctacaaggaacttaaacaaatttacaagaaaaaaaacaaccccatcaaaaagtgggcaaaggatatgaatggacacttctcaaaagaagacatttgtgtggccaacgagcatatgaaaaaaagctcatcatcactggtcattagagaaatgcaaatcaaaaccacaatgagataccatcttgcgccagttagaatggcgatcattaaaaagtcaggaaacaacagatgctggagaggacgtggagacataggaacgctttacactgttcgtgggagtgtaagttacttcaaccattgtggaagacagtgtggtgattcctcaaggatctagaaccagaaataccatttgacccagccatcccattactgggtatatacccaaaggattgtaaatcattctactataaagacacatgcacacatatgtttattgcagcactattcacaattgcaaaggcttggaacccacccaaatgttcatcaatgttggactggataaagaaaatgtggtacatatacaccatggaatactatgcagccataaaaaagaatgagttcatgtggggacatgggtgaagctggaacccatcattctcagcaaactaacacaggaagagaaaaccaaacaccacatgttctcactcatgagtgggaattgaacaatggtaacatatgggcacagtgaggggaacatcacacaccagggcctgttgggaggtagggggcaaggggaggaatagcattaggagaaatacctaatgtaggtgacgggatgctaggtgcagcaaaccaccatgggacatgtatacctatgtaacaaacctgcacgttctgcacatgtatcccagaacttaaagtataataataaataaataaatataaaattacagtgattcactaataatcatattctgtgtctgaaattccttttcccctcctttatctttctgcacccctacagagataggaaaaaccaaagtgttttttctccgctcaaacatcactcaacacaacacttctcacaccagatgtatgggggtttctctccacacaccaagtgatcagttctctagcagacaccaagtgggtgtaattcacttcatttctgatgctggctacctggaggaagagtcaaccccacagattaaaagctcagtcccacaagactgcctcccacttcaaatgccagtagcaagccccaggttatgacctgtacttctgatgtgctggctatggatctaggtttccaaaacctccttctcaggttttatgaatttgctggagtggctcacagaacacagggacatgctttgcttacatttacccgtttattgcaaaggatattttaattttaatttttgtttttttttacagagttgatatgatttactaacaagtattaattgtcgatcttgagacttctgaaatattttcattggctttatattttaatatgaaaattaataatttcttttttttaaattttattttattttaagttccaggatacatgtacagggtgtgcaggtttgtttcataggtaaatgtgggccatggtgtttaactgcacctatcaacccatcacctaggtattaagccttacatgcattatctgtttatcctgatgctctcccccttcctctgcccccctcccaccccttcaggccccagtgtatgttgtttccctccctgtgtctatgtgttctcattgttcagctccccacttataagtgagaacatacagtgtttggttttctgtttcctgcattagtttgctgaggataatggcttctagattcatccatgtccctgcaaagggcatgatctcattcctttttatggctgcatagtattccatggtgtatatgtaccacattttctttacaaggatattttaaaggatacaaataaggagccagatggaggaggtgctcagggcaaggcatgtgggaaggggtgtggagtttccatgccctccctgagtgtgccactctccatatacctccatacattcatcaatctggaagctcattcaagcccagtcctttggggtttgtatagaagtttcattatgtaggtatgattgattacattattggccattggtgatccacttaaccttcagccttcctcccctccctcgatgttgtaggttggggctgaaggtgccaaccctctgatcatgtcttgacttttctggtgaccagcccccattctgaagctgtctaggggtttcatatccactgacaagctatctcattaaccagcaaccagctatctcattaacatacaaaatacactcttatcactccagaattccaaggcttttaggagctgtgtgccaggaaactggaagaaaaccaaataggtatttcttagtatacatcacaatatcatatccctgcagccacagcaactttgtagataatctttaaacatcagaatggagaaagtggaagatgagcccggacagagtgcattccaaatcagtgctgtttcgtgtctctctttttcaccgtataatctgaagtttagtctcaagattctgccatctcaccactacccatttctaaatggaaatttttcagctggtcacagccaggagccacatatgaagaggaataagagacagaagacttctaacttttcattgcttggcaacagtaaatgcttacagtttttttaaaaaataaaattgatgttataactttatggaaatcagttgtaaaagggagttagcagatattttatctttgtgataagacattctactggtctgtggatatgtgaatagtagatcgttttttggaagacactaaaaaaattaaagttttgtaataagagatgtaaattaaagtcatcagtagagagaaatgggtgccctaaaatatggaatatttggagttataatgccttctaaaggaggatatattattataaccatcatttattcaataaaaactataggtacttaccatgttccaggtacatggctaatttctggggcaacaaaaatgacaaagttattgtcatccttgcccttgaagtgctggttaaaggtgacagataatcaaagaaataattgcagagcgtggcactgagtatgatgataaaagttaaaaaaaagagtgctgagagaccacagaagaggaagctatcagctcttaagatgcttggaaaaataacagatgaaaggacatgcattgaacatttattgaatgaatgaatgaatgaatgaatgaatgagtgaatggtgtcaccaaagcttatgtcatcacagtgttaaacactatatcctgaaacaatgacctggaattttgcaaacaaaagagaagattcaatgtagtagtcaactccattgcagaacactggggcctcaaggtgagagaggaagctttatgactcctacagtcccctaaaaattgagtaacatattttaatctgttacccaataacatactttaaataatgtaagctgcatgctgttatttcctagaaagatgtggtttcctggagataagttgtgtctaggtgaagcttctgcatgatagcttatttcaactatgtaacaaagtatatattttaaagacagccagtagtgaatctttcggaaagaaaaaagttatcttaaaagtagatgcattttgatttaggattttgcatgtctgctttcataaataggttttcatatctggtttcctgcattaccaaatgacattgaagtttttatagatttaatatttatcataacatacaactacatctattccctggaattatgtgtgggtgtgtgtgtgtgtgcacgcacatgtgcatatttatctgccaacatctgaattccctctatagcattgcaaatgtaaaattagtatgtcattcttagaggtgctgtttagtattacaatctgtagctaaatactaggctaattattctgtgaataagtctctttctctggtataatgtagcactcaagcacaagcgatcaataaatgttattatgttatatattttaatgttattctacaagttagtaaataaaatatctaacatagtaacattttttgttttttatttttatttttaaaatatctaacataataacattgccaactcttttcacacatgagttcatgtaacccttatgatttgccatctacaaccatattttaaagtgccaaatataaagttggtcattgtttctaaaaagtcagtgttctcacgttctatttgactcttcgtgtctaatagtgatatttaaagtaggtcatttagctgctgattttactcctgaataactccggtccccttaacactatcagatgttcctttccatcacgtgtttttctgcttccagttgaagaacccacattaaaaggagttgagtggaaaatggaatgagcaatacgccctcagtttactattccttccagatatttttaaatgaaggtacggaaagataagatggtaggtttgttgcggggcagagggaggatggaaggagagtttatcaaaagcgaaaaaataaacagatgagggatataagaatcattcccacagcctccatctccctttatgttctctgatttccaaacatctgtatttctatttttaactttataatagcaaaaatgttgtttaagaagtaaataattcctaacattttaaggataaattagtgtagtatacccagtataaggcaagggcccagatccatgaaggtatcagcattaaagaagacaaattacagaagaccttcaaaagcctttagaagcttatgtactccttaacagtttacaaattgccttatctccatttttcatctgtataaattgatcacatttcctcaatttctaacatagagcagaaccactttcatattttttatttatatgtgtgtgttatactcatacatataaactgtatttttaaggacacatttaagtgttcccttttttcacctgacactaatgttaagaatggaaaattatgatacaattcagcaaggagaggaattgcggtgcatgttattattgactacattcaggtatagttggacaaattgggtaatggaaccaaattggattatatgagattctggccttaaaactatcattctattatgtcttctgatgaaacacaattgaatttgagttgtgtaaactgaaaaaaaaataaataattgcaaaatgtaaagtgaaagatacaagagtagctacatagaatcgaaataaaactactcacgtaaataaaatatttcttacacacttaaagcacatatattaacattatataagaacacatctaaatgaatgcttatcactgagcaatatgattttcaaaatgttattcgaagacaacttggctgttcataaatcttttaattttaagctgccgatttacagtttttcctttcatcctcttgttttgaaggcttgatgtgggagtgctaattaatgttagaattcttatccaatgtacttgttgctaagcagatagaactatcagagcattttattttgaaactgcactcttttttgactgatatagcatttgaaatcgtgcttgaagaaacatttcatggcagggagccagttttctcattaagaacatattgcccatgaccaattcactggtttatttatttccacaatgcctgttgcccctgtggctcatacatgcgtcgtgttgaaaaccacatgtaaaagacatgaacactaagttgtcttatcagtatgagaatacacaatttataaaatcataaaacatggaagttaatgaaaagtttatttagaactgtatattttgccttccaggcagaagttcttactgactccttgggctgtcttagctgattgcacgttgacttctgtattcttcatatacgttttttgtctcaatttgagtttcttcagaagcagttcctgtgtcagaggtcctgtttgtttggtttattttataagttcataaaatactgatagggatctgagaaatgagaaaggggacagcaactgagagaagccttggaaatggtttaaaaccatgtctcagagttaagggacaacggaggtaggatatttatgcaccaactcttcagtcactggctgagtgtcacaaggtttgaagaagatgtgatgtccctgacacttaccagcctgccatgcaaaaggacagagtagtctttgaagtttcagagaaagcactgagccaatgagaggcgatgacctgtactagcagttggatgccagttggggcacactgaagcagtaacagctaagtgctctaggtgggccaccaaaaacatctgccatatcttctgtgggcttacatccacccaaagtgttatttttattctatcctgatctatggaagatggaaggatcatttcgtagttgtgtattcatttttttcattagtttgtacacatttatggatatcccctgctggggccactgttctaggcatggaggcagacaccagggaagaatatgacacaccaccatcattgaggtccgcacagtcagggtaatgggcagaggcagtgaagagccacggaaaatccttgaggtgcaaatgaagttgaatcatttactccatctatgggaatcatttacttcgtctactatgagtagtacaaaatcctactaccttctggagtggctttggctctttgtctggcattgagtttctttctctgtcttagcccgctggtctctgagtacccccctgaagatgcattcatatagaaaagggaggagtcagtaatatcttgtttttctattcggggtattttagtaactgcatcctgtggctgaaacattcagatgatttcaagattttgacacatgaagattccaggttcacctatgaaagaaaatagggagtctgcctgccaaaattctagttttatctaaaggatgccaactagcatatagcatgcatgcagaagatggccagtattacattttttgaaggagtccattacaaaaactataatatttagggatatgtacttattaatctagaatgagagctacagctatggtaatatgaatggaagcataataatttttccaaatagtattactgtttagagattgtttttgtttctcttccttaggttttttttttttttttttttttttttgagagaggagatagaggtggctgctgtgatggcaatgatagctatggttactgtcttattgaatgcctattattatattaacaaaaccgaagttcagagaggttaattaacttgtctaaaatcacaagcttggctgggcatggtggctcatgcctgcaatcccagcactttgggaggccgaggtgggtggatcacttgaggtcaggagttcgaaaccagcctggccaacatgatgaaaccccatttctactaaaaatacagaaaaattgctgggtgtggtggcaggcatctgtaatcccagctacttgggaagctgaagcagtagaatcacttgaaccagggaggcagaggttgtagtgagccaagatcacacaactgcaccccagcctgggtgacagagcaagactctgcctcaaaaacaacaaaaaacaaaaacaaacaaaaaacccccaaaaaatcacaaactagtcagtcagtattttgacctgagtatcttgaattctcaggtgtggctgcaagacgtattgataagaaaaaaaaaaaaaaaaggtacaacataagagaattcaagtttcattcacttttccagcaaatattctgtagaaaatccactatggcccagccacttagctaggcaatgtgagtaccaccttctaagacagagaaacaaaaccttcccctcatacagcttaccatccggtagggaggttagctaagctattaaacagatcagtacataccgggggatgagtgttgtgatgggaaattcagttgataagagagcccgaagccagaagacctcattgattttagggatcagaaaaggctttctgcaggaagtaaattttaagctgaaagttaaaagaggatgactaagctaaagtgggagtcaggggagcggaaaggagagaagtgttctaggcactgggaaggcccagaggccttattctagcattgaaaggacaatgtggctgggacattgagttcaggagggagagtggagacagaagaagccgaggagatggaagccctgtgaaagatgcagcagatatcatgatgttgttcccaacctaaaagccctgggaagcccatgaaggagattcctctggctctggtgtgtgggcagattgaagaggaatataccaaatgaaaggaagcatcctaagtaattctgatgatcatcccggagtgctgctggtgaaggtggacagagtagatttctttgagagatactgaggacttaggaagagaagacttgggagagtttgcactgaagaagggagaaagcaatagcattgtctgtgcttttgatttgaaggaaagggtaaatgttagtgaaatagcttctgaaggcctttaagaagactgcctacatagaaagcctacttctatctgccggccaaagatctggaggaacctcatcctttcattctaaaaggagtcgtggatgtagatttaaccgttctggtatctgaaggtggtgggattaggaataatttttcttcctttttttttttttttttttgttttctctgctttagttttataattaaaaaggaattttcttataaaaatacagctactgtgatatcttctgctgaacatgtggctcaacttactcacaaggtcaggaaagttgggcccaaggcataactgcttaaactcaagaaaagagaaaagacaatttcatcaccagtgtaattaagtgagcttccctacaatatcttaacttagcttctcatctaagtaatatgaatccaggtatagtgggttttggtgtttattttaatcttgtattgtcattagccagttagttacattagttacccttgggtgtattgtggaaatagatttccgttacattctttttttcccccctttttaaggatttagagtattatgcctgagtgaattgattcatagggattttacttactcattcgttgtgcgctgctgtgtttttgttctccatctggttaagctgccgtgactctctgtatagcatttgcacagtgttcacatgatgcttgggtacttaggtgtcagtttttcattatgcccggatgatgtgcgttgcgtggaaagcctccggaaccgtaaactctcatttcccaatcatgaatagttaggaaaccagagttcggcattttcattaacatagggtcttacatgccagttcagcttactacctgctaagcctcctagtctgttggaaaatgtgcattggcagttttccagtcttgctaagactcataaatagatgcctttcatatgaaatgtatttgctttggcatattgacactggaatacattattcttttagcagttgaacaaattaaaataaaaatgatgacttctttttttcagtatactaaaatgagcataattgggttaatatcttaatctggcagtcaggaattagcttgtatacccacaaccacataatttcactaagggaagtttacatgtttccttttccttgttctgttgatgaccttcctacgtgtcaataactagcagagagtttggtcagataaaggggttggaataacctggagagcttaccaaaaaaaatccttatctctgagtaccatctctgtaaaatcctggtttaattggtcttgggttcagcctgagcacctggatttttttcaaagttcccagatgatttcaatgtgcagtcaaggctgagaacactcgctctcatcatgtgtaccagagacaatactttcgtaagcaaacagcctcacctaattgtttctttctcttttgttttccctaagtctagtccacatctttgggcatggtccttgagtaggagaataagagagctattgaatggtccaagaagattcagatggcttcattttacactccagttgatcatatagaagtttagggagaacactcaagaccactgggagctactatgtaggtgaatagatttgtccaagacccactctggcacttccaagctggccctggtgtactcatgagtaaagcctgccagtgtatacttacatttccaaagacttccgtttagtaagggctgcctgatcttataggtgcctcagactggtccttctacaagtatagttgttttatttcatacttctaaatggatgtttgatattgtttaggattcaaatgtttattcagaaatccataaagtaggtatttgacatctcatagttttgaacaaaatggtaagaacaagatatatcaaaatatatcttgaaggcatgagtaccatagaccttttagaagtgcattttctagcatcttgtacaaaacaagacccttatttctgtaaaacttgatggaccttagctgggaatgtgatatcacttatccttcaatgattttttaaaagaattatacctgcatttaaagccttggcaaaatatggtaacattctagctactgaaaacccataagatattgtcccacataagatggataactttccactgaagatggataagttttagggtatctgaaccttttaaaccttgtgggtatcatttgtataatattctacttaatagtaaactctgccattcacagtgtcccctttctcatttttctagctacagttttcggcaagccatttggtgtgcttgcaatgctatcatgagctatggcttggcgttacaaggtctggagagtgaaagtgttttctgagtttctattttcaatagttattaggaaaacaattgaactttggctatttcctggtaggtttaactttcatttaagtgaggcatctgaatatttttgttgaaaatataatctttcaccatgaaactatctgagtttgagatttcagttataaaacacgctcttttcagtcattgaaaaaataacctcctgcaattttcctctgaaaaataaaaatgtgctttgatagagttttcgataattattatcatacatctgtgcatgtacccacaccattgtgttcatctcccatccatgtcattagtgaagatatggattaattccacattggatttcattgtatagaatctgggtatttatatctaaaaaaaagtgctgtcatttgattacatttaggcaaattttctcagtttataatctagaatgtgtgtttcggtcttcttctttaactggatgttctcaaagtatacttaaatggcatggccaaaccattgaagaaatacaacagtgatgactagtttctctgtgtctttccctgttcagcagttatagaggcatgattctatgattatttttgtgtaatctttgaatatgcaaaacaaattataacaaaaagctgtggactcttatgggattctaggtcgtgtatatttaattttcagcagcaaacttctccctatttgtaacttgttgatcttcttcagaaatattttcttttccatttaaaaattttaaactgagactacaatcaaacctttttcttttcttcatgtatagcaatgcttaagttatttgtatttcttataattaattttatctgcaaataacagaaatcctgaaataatagtggcttaaacaaagtagaagttaattttttatcctcatgttaaaacaaaaagtgcagacataaggagtctggagctggcagagtggctcagctgtcatcagggacctgggtttctgtatccttagcacactcaaggttgcctcatggttcaagactgctgctagattaccagccatcgcattaagaaggaagctagaaaagcgaagtgggaaaccaagagagttgtcctcttctttacaaagagtctttctgtggatcccatacatcacttctgcttaggtcttgttggtcagagctaattcacatgaccataccttgctgacgggaaggcttgggatgctagaactgtagttgggtgtaataccatcccaaatcccaaatatatttggtggctttttttgtttgtttgtttgtttgtttgttgttttttcgctaagaagaggaaatagactttgggataggaaatagcagtctttgctacctcactgttttcagattatgatattgtaagatatgctcaaaatactccaagtacaaatacttacattgcttgttgacagagtaaaataaattatataagtaaagctagttaggaacttgccatattggcagttcattttgaggatatttctaaaaatcatggactgcaggaggagaaataccaaagccaaacacataaaaatttcccacaactatatgaaaattccaaaatttatctatatggtaatcatatgtctggtgactttatttattcagaatatctctaagaaagagagagggttgtatatttgaccaattgtttttgtcaattcagagctgttgaacaattataaaattccaaagttctcagaaaatacttggctagtcatggtattgcatactgtagcttctttaaacactctgcagaattcttgggagttggtcatcagtagcagacggtaagaaaggttatgaagtctcctggttgtctgttgctaaaaaatcatcccaaaatatagtggcctgaaacagcaacaattattgatttgctcataattctacagtttggacaagattcagtggggatggcttatctctgccccatgtgccatcagatgggatagctcacctggaggggctgaaggatccacttccatggtggtttaatatacacagctatgaagtcagtgctggctgtctactgggaggtctcaattctcctcacgtgacctctccacatgactaggctgagcttttcacagaatggcagctgatttcaaagagggatcatcttggagaataagcattccaagagtacaagtcccagtgtgcaagtacttatccagttttttgttaatgtctcattagccaaatctagtcccatggcaattgggaggggctacccatggatatataaataccaggaggtgtggttctttggaggccatgaaagaaactttctgccacatttaagttctcaggcagaaaaaatagtgtttattgaggtactaccatgtgccggtcactgtccttaaacacagagctgccctgcataaaaggtcttattcgtcccattttccatttaagataaatgaggttcaaaatgttttaaatgacctgcaggaggttacaaaggtcctgtggtgaggctccatgtttcaatctacctctgaaaaactcctaagtctttgcactttgcagggcctccagctgcctttttaaccacatggtccattgtcactgctgcaggcacgtctgccctgtgtgctttcactctaagcacaataaaagacttaccacccgataagtctgttttttgaattgagaacaagagaaagagattcctgaacattctaattaaccaagtaccgctcctgtgccacagagatgcctagcagtgagagccgtaaaaggaaagtgcttggcagtgaagcaagacaagaaacctggtcctttgtgctctgccccattgcaagctttctcctagcaaacctgaccagtgacaacagtgtccaaagtcttttctagaaaggtctccatattggtacctttttcctgaagtaagggcttataacaagggcattaaaatatgctaatttctaatgctttctattaggcgtatccacatatcaaagcttttactggaacacctttgtcaaaaaaaaatataggtcatgcacatggccatgaaattccattctttatattttaagcagcatcaagattgttcttttccttcgctgtttggcagattagaattcctctttaaagtgggagaagttagttacttatcaaaccatttgattaattagctagacctgtcaggccaaacaggactagccaagtcttttaaatctcttaatatgagccaattttcacaataacttgttttattcatggccttcacattttaaattcttgctcattagtgacctggtatttgggcttgtctgaaaggagagcatccgttgtgttaaacagggctcattatggattataggttttcgaatggggatgcctatgcacaaaagatcgccctcccattttcctctgaatagttaattggaccttcaccttgtttttacaagcaaaggctaagcttcaataaggagataggcttttataatgccacagtttgggttgtactgaagagctggtgacctatcattatcaatacagatgtggaactaaagtacagcatgtgtttggttttgctagagacaataaaagtaatggctgtttttaaaaccagtaaaacactgaacttgatagaaggagaaattcattgaatatatcactctgcaatagttcaattccttgagtaataaaatacaaccaccaaacactcagaaataaacactagttaaaaaaaaaaaatgaaacacaagcctgaacccacaatacccatgcattgactcccaagaaaacagatttttacattccctaataaatacatgtattactatatccccaaggttttagcatcctcattgtatatcaggctaatgtctctaatacaaattctttttgaatttttcttagttaaaataatcttctgttttggtgtgtattttcaatttgttttaagattctgtttctgttgcttgcagtaattctttttattttcttttcctacagaatttactgtttatttccaaattactccagaccctaatagtctattttgcttttggcagaattcgtgtatctattgagttgcattctgttttgttgaatttcactcaatgcgtgtctctccaaaggcttcgttcagggacaaaacattcaactgcttctttagggcctttgggttgtgtttgtaacatgtatccacaatcagctgtcataataagccgagcatcctgattaattcactgtaccctccagtcgaagtattcacggatgtaactagttgaaatgcggatacacaagttcctactggtcttaaaagaaatgatttttctggtagttttataattttagcaattcagatttcgtacatttgaggttagaaaattcagcagacagcctaaatgcggcatcatgctaatggagtcctggaagctgctggtgttaaaatgagtaaattaaggagtcaacactgcttatttaggcacattaggataaaatagtatgagagctcggacttaacaaaaatcaattcagcacgcagagtgcacatccatcagggctttgttatgatgtcagggcgagcagcaaccctgttttattttatgaagaatgctacattagcatcatcgcgtccttggatggctgtgacatttgctgttatggaactactttgcggcagccacagggcccccagggactactccaactacattaaaaaattaggttggcatcaaatgacttattgaactctgtattgatatccttgggatttggttgtcaatctacacagtagttagtctcctttcacagcgaccgcattaagtaggaagttgtaacagttattgacgatttgagcaaattattttcctctatccagcccctacatacaacaacaatagtaataaacacagcttgagtgaaaagtatattccacatatggcatggatgctttgtttacatggtacgtggttttatttcacaataactcctaggtagatattatgtcctttctgagatttaagcattactttagtcacttaatcaaaaatcataaactgaagctcatgccattgaccccagttatataaaagaagtttgaaattttcttttgatctaggttttgcaccctgatagacttcacagataatgtaactaattagtaactgtgttttatttttgtgtacccatattctccttgccagaaaaaaaaaaaaagttgttggaacatactctttgctgtgtttcctcttggaaactattagccttcattattcagagtattggaggttagatatttaattttacaagcctaattattgactaacattttaataaacatttgacatttattaataagaattcaaaatatataaccatttaattttttacatactatctaatatctaatagtctcatatgaagtagaaaaaattacattcatgaaacactacactctattcatattatgatcacaccatcttttgttttccttcttttaaaatttttattttttgattatgaaattaatgtgcattcattggtaaagttcgggaaggcataataaagaaaataaagatgatatataccaattaaaggtaagccctgctaatagttgatattctttcagaattttttatattcattttcttctgtatatgtatacaattttcctatgtttgctttatatatattgttttgcaactagttcatgcattctaagtatatagcagaatttgtttcattaattacttgctattggaagttggttctgagctattttgaggatgaaaaacgtttctttgaccattcctgtatatacaacttctatgaaagaggcaaaaggttatgcatgctaaatattcagatgtgttaccaaaataccatccagaataacacctatgtaagaagttccctgattctcacttcacttttagggttaactgggacagtatggacattcttttcttaattcagtcattcaaagccatttgagtgcttactatgcattaggcactctgcaagacccaagagacagcagtggtaggagacagataatcctgctgcttacctggaatgtaccatgcaatgggtggagactaatctgaaataaataattgtacaaatgcctttctaatggaacttgtgctgtgaaggaatgttacgtcattgaacctgatctaggatggagagtcaggaaaagcttccctgaagaggtgacatttgacacttgaaaggggcaggtgtaatgagtttaatatatactgtgttacatcatgctaataactattaaccattgcatttttactgaggaatgctatgtatgttttggcacatcttaagtcagataattttattctgttttattgttggaccaaaaaaatggacaagttctcttttccacttctcttcccctttttgcccacaactacaattaacatgtgatggtccagaactattttttccttcttttttttttttttctatttaatgttacaaaggtaaacgtgtgccatggtagtttgctgtgcctatcaagctatcacctaggtgttaagcccagcgtgcattagctgcttttcctgatgctctccctcccaccgctccctgctcccccgccccacagtgtgttgcagaactatttttttttttttttttttgagacagagtctcactctgtcgcccaggctggagtacagtggcacaacctcccctcactgcaatcttcgcctcccgggttcatgccattctcctgcctcagcctcccaagtagctgggactacaggtgcctgccaccacgcccggctaatttttttgtatttttagcagagacggggtttcaccattttagccaggatggtctcaatctcctgacctcgtgatccacccgcctcggcctcccaaagtgctgggagaactattttttaaaggaaaatatggtctccaattcagaagagttgcacatctccaggatagggtttcatcttccaggcagtgtattcaggcagctcaacactactcattttttcacctgagccagctgaagttctagcggcagttgtctaatgatgatttttaagagtcataagcaaaaatgaggggacattggagcagtaccatatttagaatgcgaatattagtgcctccatagtctgaccttttctctctggacatattttatccatcactgtgtccacacatgccaaaatgactagtaaggaaatgaaaatatgtggcctttgaatgcaatttgtgaccaacattattttttgattaacagaatatatttttgtttcattgaatcaattattttatttagtatcagcattaattgtctacagacaaaatatctttggttctttgttaaacatttcaaaatgtgctttttattgtataaaactctacaactattatttccctagaagttcaatgcatacattgataatttattatgataaattgatgcagaatattgcatgatgtaatatgagtttcatgttgaattaagccatcacccctaaatatgaatctcaaagagctgtggctatttggtttctttatccaaagaaaaaatgattcataaccattgttgatgcaaatattactacttaagatgcaatgggtttctagtttcctctttgctgtgtaaaatgtatgcttggttgaccagaattcagtgaaacctctcattagggcactacggttcattaaggtttaaagaggcatcactgaaatttgaattggccatgctgtgattgccaagtctctctgagtggtaattgggctgtgttatgttgtgtgctttactgctgcaatggtttttagagttgttaaaaaataataataatagtgattaagctctgtgctatgtaaaactggcaagtttcttagtgatggcatctttttgtttataaattgagatttaaaaaatcatattcttacaaaaaacattcaaacaccaaatttgaatatcatactgagtttgttttttacttattggaaagagtatgttaacataattttgtttctatttcattttctcaaactggaagaaatatctggatgtgcacatagcactagaaaaatcaataagtaatctagatattgatttactgaatacccaacatgcagattgagagaaaccatattcaaaatgtgacaattcagttaaaagtgaactgaaacaagggtgcggttactaataggcagggaattactaggcagatgcatatcagagccagatccccaagggaagggcttatttcacctacgtgatagcacagtttgtactcaggcacttgagaaacaataatttaccataattgaaccagccacaaatatttattttgttaaatcagacccacaataccagcctgtctgtgctttgctggctagaaaatgtcctcatgagtcttaaatttatccttaaaatatatttaaaaaaataatcttaactggctttacctgtacctagttcaaatcgttttctctttatgcacggtgaaatctcaatgttggttactgtttctgcacatttccctcgggatggtggtttgtgagcatacctacctgtgctgctgtgttgcgagcctcactttgctcacctgggtttccccaagtgttgtgtttcaccactgggaggaactggccactgctgtcacctcaccacctaccataaggcctaatatatgacatatgtctaatatatatttgttgaataagttaattactctggattcctacctgtggcgcagtggctgacacacatatatctgcactgccttttgtgagtgactgaatgaacgtatgcatttgccatttgggaatattttcagttttatcgacgtgactgtttagaggcataatcacagacttataggaaaaaaacgtttaggaaataattctttgcagatatccttttggaatatccatgtaagatttgccttttgacagttactccccaatcctcctgcctaccttatccctcccattaaaaaaagagcaacaacagccgggtgctgtggctcagacctgtaatcccagcactttgggaggccgaggagggtggatcacctgaggtcgggagtttgagaccagcctggccaacatggcgaaaccccatctttactaaaaaatacaaacaatagccaggtgtggtggcgggcgcttgtaatcccggctactcaggaggctgaggcaggagaatcgcttgaaccgggaaggcggaggttgcagtgagctgagatcgcgccactgcactccagcctgggtgacaagagtgaaactccgtctcaaaaaaaaaaaaaaaaaaaaaaaaaaagcaacaacacaagatatctggcacacgttgtcctgccgagttgttgtgagtttgtcatcgttttcgtttgttgttgctgttgtgtaagcttcacgtttggtgattgttatgttcttggggatgcattctgactatattgggtccccttgagaccagtgttgcaaccaaaagaagcagagaagatgtagtccctaccctcccgcacctcgacttcatgcctttgcgagttttttttttttttttttttttttttgagagggagtctcgctctgtggcccaggctggagtgcagtggcacgatctcggctcactgcaagctctgcctcccgggttcacgccattctcctgcctcagcctcccgagtagctgggactgcaggtgcccgccaccatggccggctaattttttgtatttttttagttgaaacggggtttcactgtattagcctcgagttctttaactacttgatcttcactgaattgatcaggctgagaaagaaacagaacagtgtcagaagccaaccagtcaggtgaaaatattgtgttttgcaagtaaggggggttgaagaatgagagggatgggaaggagggaggtacagaggaggggagaagagcaggtgcgctaaggtatggaatggcagtttgaggaaggctgggtccacatcttctgttctgatgcaaccccctcactgctgcttcctagagggaccttcagaaagagccacatttgttttcaaggctttctggagttagacttctacctctttggggtgccccactggtctcaagggaatccaacacagtcaggatgcatccccaagagattgtaaatacatacaatttaattgttataattatctttttcctgtttgcatctcagttaaacattgtaaaaaatgttgagatgctacttctcttaatttcagttccctcacagagcagagcctgagtcaagatcttgagtgcaagcagtttacttgacttgtttatttgacttagcctgggaagtagaagtgaggtagagagtgagctaagaacaggggaaaacccagtgaaggatgtgctgtttagggggttaccactgtgggcaactgagttttggtcctgctgggaaccctctgaagaaccatgtagtaaatgtaacctcaaacctgcctatctaagtagcactgttcaatagaactttctgtaatgatggaaacattgtgtgtccacactgtcttctgccatagccacatgtagctgtttagcatctgaaatgtgactagtgtgactgaggaattacatttttagcattagttaattttagttaacgtaagtgtaaatagccatatatagctagtcactgctggattgcactgcacaggtccaaaggattggatgttcaggcgtttatcactaactctcattccatacgtggggcttatggggctgtgggtgttaactccctcatacttccaacctgccctgcaaggggctaagatagctgccatgacttaggagaaatccctgaggaagaaaaaattgagagaatcaaagtccttaagaggagacactgccttgatacaagaaaactgtccctgacagctgcagaagaaatcacaggctgagaggacacacaggaggcacaaagtacccgtgtgatgccaccttatgaggcattgaaaaagtgacagtttggtatattcatatctgtttttacgattctgaagtatcaaagttcacatcataagaaacgtaattctggtaataatcctgaagttttcagttaatttaatgcttggaaacttttaatgttttctaaatagctttttttcctctcttttaaaacttcaattatttcgattttactctaatgtaggtactaggacaaaacggtcacctcattagtatgtagtattttctgtgttttcaattattacattttgaaatgctagtggaaaatgctgtctgccttacttttttattttcatagaagtgtatttgaattggtttcaaccaccataaagactatttcaacttatttgttactaatgatgccatagcttagtaaattgcataagctgaataaaaatagtataacaaaaaatgtggcaactctagtgattcaaaatgtgaaaaatgatgaggctctattttcttaaagttagatttaaactattctatgaatatttacattttaaaaaattaaattttctgagaaaatcttgcttatccctaaagatacccatcaagctgtaaaaatgtagagtttatatagataaatgaaactacataatatattagagtgttgctatgtagatatgaaaacaaaatttactcttgctttttgcatttctatgaaataactgtttaaaggttaggaataaaggccaaaatttgcatttaaatggatatattttaagaagaaatgccaatttgtgacctttacccttgccgctagtatggttttttttttttaggattaacaatcaaacttcagaggaaacactagaaatataagcaaattgatagaaaatgtttagtttaaacagcttcccagaaaactgtttttatagcctgtagggagggctaattgggccttgtcatgaatcagtttaatcatgtaaaatatatttgatgactgcaatgatagtgaaagattgatccgtagtggtataaatcaggggtcccaatcactgcagactcagtggaaatgaatagttaaaattcgaagggacccattaagtgtatgatggcaatcacagatttaaggcttcattctatatatttatgtatgcattttaaaatcttaagaagatacttcaaaatatattagagaatttttaaatttgtaaaatctacaatgggtactacaatatatctacctgtgaaccaccacagttgctggttgaaattactttattctattatcttccaagttgtattagccattgttagatttcagtgttatcagggtaatagaaattaggtagtgattcaaagtgtgttttaaattattcctctcttttcattgactagttgcatgtctatgagaatatgtgtgtatatatatttatatgtgtgtatatatgtatatgtatagtctatacagattgactatgtataatatgtgtgtatatttatatatagactatacatatatagactctctatatatacatacatatgtatatatgtttgagtgagtgaatgattgagaaacagatagattcatcaaagctgactctcccctttatgtggtatagtagaactgaatggaacatgtttttagtttagtttttgctgatgtgtgcatgtaaagtcctctataacaacctttttttccaaaactgtgccatttccggcactgctttttcctccattgttactttttgtttattacttgcaccttggacacatgggggaaaagtcaacctccctggacaggttcaggaatcagaggatgaaggaaagaggatacatgaagacatatatgaagtaggagttctatttagaaatgaaagaacatgtgaaatatcagttaacatcggttcatatggagtccaggattctatttaatatatcagatagtcagtaaggtctaagagaggcaactgaagtaccctatttagaggaaagttggcatcatggaagtttgttagccattgcctgggctcagccattaggaaattgatattaagttgggacattcagtccttggtctactagagaaaaagacttagaaatctaggctcttaaagtctgagtgaagctaagggcaagtacagaggggatgacccaggagcacagtgcctatgggactgactctacctaattgtagttgcttgaggtcaatgtatcattgaatccacttgctcagatactggaccagagcaatttctactaccattgctctggaacagggcattgcaccattctcttagaaactggaccttaagaaactgtggccatttcaattccattttgatatttattacagatttcttagtagatgccagacagtgtgttaggtcccatcactcatattgccttagtatccattagggctaagtaccattttcttagctacactcttccgcatgtagcttatttaggaaaagtcgggcaagtgggttacagacatagtagaaaacattatgtcaaataacaacctgcccagcaatgaaagattttaccacgtcctttttgattcctatttttgctaaacaggtttaaatccttaaatggttacagaattcccccaaagagtagattatttgtaggtattagacaaaaacaatcaaacaaacaaaaaaaaccacaacaccataaaactaataaacacacacaaaaagtgaggggtccgtactcaaaaaaaattttggaaaagagtgggttaagcaagttattttacttctactgcagaggaggctttcagtttgctgttacgctgtaatacccaagagagactaatgtatgcagagtttcccaaaatcatttgatctgggaatagtttgtattgaagcatctttagtgactggtgtcctgtagcacaaattcgttaaaattccaatgctccagttttatccatcactaggaggagctaacctcagagaaactcagggaaggatgctgggaatggacctgctggttgtacttcaaaagaagcaaaggcaaaggggtccacacagaagccccaaagagaatcaaggttaatgaagggctctgcatatgatgactgtctttaaagtaggaatcctccaatctgaaatggcacagacactgaagagatagaattaaaatgtctaaaattatgaatgttatccataggttgcctatactagtcaatcaaattctggaagatggaaatgactagataaatccttccccttgctcccatcttgaggattaatttatgggtaagaggtccatagaggcttgttaataggaaatcagacttttacagctatatgctaacttttggcaatgatagacagttaaacagaatacttacctgaatgaatcagtttggcagaaacatgcacaggatttgaaaattttatgattccaaaagcatatctgaacatatgccaattgataacaaatattagatgatccaagaactatttggtgaaataatgaaggtagtttgtatagaaagcacctgtgcttatagagttcataaaagtttttcaaaatgataagaggaaataaaactcttgtaattaactagaaagatataatgtattgatctgtaaattaaagaattttaaataatgagtgttttctctcttcactcttgagcctgtttctttcctcaagaaaattttgattcctaaagactaaagtggaagtgtttattatgtatgcataataaatatctagaaaataataaatatctaaaaaaagacaaatcaacatctgacatgaactttgtctttccaaagaccatagaatgggctatgagtgaatatctttacaaagacaaacttatcattagaacatttttggttgtctaacaggcaggaaattgttaaaaaaaaatcttgttgcagtaatggagaaaaattagatgttcataggagctcccagtgaggataatcacatctgaatgcatccttgaaaataaacacaactcaacattttagtgttctattatttaaccaattggagtatgaatggatatgtaacaaagcttcaataatgtgtttcctcccagtaattgcgtttctttgtaaatgtctgtcctttgagctaactgtgtcttgaaatctcctgacttcataattctcaaaatcaggtgtctgagatggtactacaacaggctacttgagataagagtgaccatatttaatgatattgaccagtcaactaaacaaaataattattttgatcaatctttaccaactaactagcaaaatttaccttactatgacaaattctaatgttttacataggaaacaaaatactaatggctttacctatatcatgcccaaccaggaaatttaatttgattagtgttttgcatatactaaaatatttctatctggatacatgcaaggctccacagggtggggttagatttttttttttcaatgatacattccacattccccctgagggaaatgtcaactattatcaggcacagccaaaaaacaaaacaaaacaaaacaaaacaaaacaaacacatggaaacaaatgaaaagaacaaactgaaaaagtgttaagtccatactattgggcaaaaatagtagttaacatatgtaaaacaaggagaattgttcaaagcttttttttcttcttgatatgaatttgttgtaaggcaaatatcttgtttgagtcatttgtttattgtgtgtaagtgtatgtgggtgtgtaatcattttgcccatctcttttgtcaggaaccattaaattcagtgcccagaaagatgttgcaaatcagctactataaaattagaatatgctagaaacttgtaattaatagtataaaattcttttacaagaccagacgatggttctacattttatgttatattaaaaaatgagaaaacgtcatttgtgaaatttaataaggcagaacattattatgttcatattgaaagtcagactaatctgagtggattaagggtgccttgtggaatatcttgtgttagttgactaattcttgtcctcattattaatgttctgcagcaactgtaatacctacaagtaaacatcaattgaaaataacttcataaacatttcttaatcaccacagatagaatattgtttgctgtgttaatgcagattaaatagcataaatttacttttatctctttttaaaaaaataaattttgaaaagcagattagtgaatggcagagctgtcacccttgataaagctgtttcacatctttggagagcttaaacatgatacactgaagtgtgttcactgtcccttatgagcattaagtggtttgtaagataaaagagagaaaccagaagtgagaaggtttctattacaaacttagtcatatcatataaagggatggcgtagattaaatccctactcccaccctttgccacctccccttcactccccagaacttcaactgtcctttatgacacacaactgagcaggagacatagaatcacatttttcacagggatttgaaatgtctttgtggtcatggtctggcagtaatagaagccatatgctgtgggtcaggaagaaagctatctcgaaacagaagaacccatctcctggcctaatgaccttgggaacgtttagtcatttcaaggcatttatcgttgaagcagcgtaggggtcgtttgggctatgttttcctccatgtgactccaagttgtgagggggagaagtgcatattatccataaagaagacagcatcagtgataagtaagtggctaatgtcagtagcaataaaattctcttccagggcacctgttagctgatttgttgtagattgatttgcatttccctttgtgattttgaactccttttagcttcttaatactttaaaacacaagtctgatggaatgagagatcgcatgaaagaatttgatttaagctgagtactttgtggacattggaaaagcagcttttgtcttaaattacattgcctttggaataccagcatgtaagacaaagaaacatgatctttgtaatggctgttggcccatctccagttgacacacacatgcaagttatatgggctgggtcacttgaggtttcccatttcccataaaataatgtttatcatggcatggtggggcttaaaattggttcctaagtaatttttgctccagtctcttatagttgtctctgagtatgtccccagaactgacagtgatttggaggcattgaccatttaacatgatactggtggacattgatcagatggccagtatttgggtaaaacttatatttggaagaggagaactgatttttggatattaggaaaaagagagccccctccccaacttcaccaacactgctgaattccgattataggtataagcaggaattttctaaaattttagattaggttttaccagaaattctcaatattctactgctgaatctttaaactaccagacaccttttgctctccattttctcaaattggaaaggggtgatgaaaatggtaaaatgtctcttccctcttcctttgttctcagggatgtttgttactcatccttctacttgcagctagtatataaaacatcttttagagtctccatgtcttttttttttttttcttttttgagatggagtttcactcttgttgcccaggctggagtgcagtggtactatctccgctcactgcaacctctgcctcccaggttcaagcaattctcctgcctcagcctcccaagtagctgggactacaggtgcctgccaccatggctggctaatttttgtatttttactagagacggggtttcgccatgttggccaggctggtcttgagctcctggcctctagtgatctgtccatctcagactcccaaagtgctgggattacaagcgtgagccatcacgcctggccagaatctccatcttaaactggcttcctgaaagagtaaattgatcaagcttaaaataattttctgctgttctttttttccagtagggacaaggtcttgccatgttgcccaggctggtcttgggctcttggactcaagcaatcctcccacctcagcctctcaaagtgctaggattacaggcctgagcccccatgcccagtctcctggtgttcttggagggttttcctctgtaggtacttgttcatttgtgtccagagagacttgggagactataatcaatactcttatcagccagaacaacatacattaaaactaaaagaaaaagaggaaggttgagttaaactggccctaaaaatattgatgttctctcattggaaaggttgacaggttctttcaaggaaaggtcatttcaggaacataagaagtctttttcactttactctttgctcttatctgaaagctcatcacagtgttctataatattttatcatgattctgataggtttcaggatgaaaaatggaatttggcttaaagagtgcagggctagtatgaggacactgcactctgaaataagtcagagtgatttgtcttcatcagatgttccataataatacttaacttttactgtatgacgtgaaacgagtgttattatttcaaaaaatgtatttgtaaatttcaggtcaaaactaagaataactctaagagtgtaaaaaataacatattttaatgttaaatttttttattgcttacactctaaatattttcctttgaccaatatgagaaatattcccattgatatctctgtgcatttaaacaattgtgaaaatagagaactcagttatagttaaatgactgatgttctataagataactttatcacatagataaaataatgaagaaaagaaattaaataggcattcctctgagagtttctctgacaatcaaatcagaggttttgattgaaaaattccctcattaatgtagattgagtgaatgaactaattactttgtaatttgttctaatagaaactttccactgaggtgaggggcaaggggaaaccccaccgtcttcactgtcatggaaaagataaagaagtaatggatctttgaaatatttcccctaactttcaaaaccttagcttacagtgttggagactacctgagattacctttcaagtagatgttttcaggaaaaaaaaaagaatatagaaaggcagcccttgccacatacaatgtatttgaatgacactacaatgcagcttttgtaggtgatcagatagaagtgtcttgctgttctattgtatttcagcttgaatatccttcatcaaggcagttactgcaaaacaatgttgtaaatgaaagttaaaatgacattattataagtaaacttgagttttcttttattacctgtcatttataaggtggtaatgcaccacgaaaggaattgcatattttgggtaataaagaaatattctatgaccttggtattacttatactaagattggttttaagacttttattttgggtactatagagtagagaccatgtcattccccctttcctaccccatttagacattaagacattcttagtgatttttttataagtacctgtcttcatccattttctgctgctgtataacagaataccaccaactaggtaacttacaaagaaaagaggttttttgtttgtttgtttgtttgtttattcacgagtctagaggctgggaagtccaaaattaaagggctgcatctggtgagtgccttcttgctgcatcatggcatgattgaaggcatcgcatggcgagaccgaccgttctctagagagaggaaatgtggcctaactcccttcttttataactgtcccacttctgcaataataaacccactctcatgataacagccttcatccattcaggagggtgctgccccctgacctaatcacctcttagaggtcccacctctcaagatcacaatggcaattaaatttcaacatgaattttggaggggacattcaaaccatagcagtaccttttttctgaagtctccccagagcagtaatctttagtcctgaatatttcactgaaacacttacatgtagaggtattttcttaaaattgagacctgtctttattaaaaattatttatagtgatactcttttctgttctgtttacagtatatctgaggaaatataaagtgtatgctattaggctttgtaatgtcttattattaaggcagatataatagctttaaagagaacactgatggatagctttttagactcaaagcagatatttgtgtgcgattaaagtagaaaatgataccctacaattgttgagacatttttgatgttctttggctttccacactgatctttttctatctctacagttagtttggttttggattaatgtttttcattcagatataggaaatcagtagcacttgaaatgccatccatagtacactgaagtcttcagtgaaacaacagagtccaatattcaatcagaaaagaaaatgaactctaggagtcatttccaggagacatgtctgaagtcaaacttgggctttatttcctgtcttcagagggtgcactttcatagttgttttctataaggttcaaatcccagagtgtatgtgccactctctctccatttataccataaacaaaaattcaggtctttatcatttcacaccctggctgtcaatgtggctgtctctccagcttctggtctgctagctccccttctaccatccccaactcttattccctggcttaatttttataaaacaactatctgatcatctcatttcatgttcattaactttttttttttttttttttgctgcctctaggatataatgtctaggctctttgtgttatgactggggctaggaaagaaagccattatctaactgaatggcctctgaaggaaatattagagcttttctataaatttatttttctcatccttctaaatctgcatgtttgtatatattttattatatatatatactttacccatacagtagtatatgcatataattgatgaataaaaatacatatcttgggatatgctcaaaatacattttactaagagaatgcatacatgtggcagttatagattattaatgtcactttatttttctcttcttacttttccactaggtgagcaaggcaggtaaattaaatctgtcctgttgatggactgaaaactaacctcaatacattctctcaaatatgctacaggagttttgatttgttcatgaatttatttttattttcctacaaaggcaactggtaaacactgcctcgcttttgtttacctcctttctttttgacttttctttctgagaacttttgttttcttgggcatatttcaaagagctactaactttatttcttacatttggcccaaactggcttctatttgcccactcttgttaactcctttgccatgagactgtacttttaatgtatactctttgtttgtacaagttcttttcttttcagtagttgtttctctttcagccttaacttatggccctatgttctgatgcttgcaacctgccaagtactttccaagccctacacccctgtggtcatctggtacaattggtactgccattagcaccacttccaccatcaccaagctgtcctgcctccattagttcactttgcctcttatgcttcttctctcacatagatatctcagtgcatatctgagactatcctggccttccacctcatggttcactcacactgattatgagtttttcttgttctaggagctaaaaatatctctcctgccatggcctgagggtctcaacattccatattctcttcatagtaagataattttttttcccccaaaatcccagtagtctgggtggcaaagtactggttcaaaaaagttgatagtcccagcactttgggaggctgaggagggtggatcacttgaggttaggagttcgagaccagcctggctaacatgatgaaacctcatctctactaaaagtacaaaaaaaattagccaggcttggtggcagatgcctataatcccagctactcgggaggctgagacgggagaatcgcttgaacccaggagatggatgttgcggtgagccaagatggcgccactgcactccagccttggtgacagagcaagactccatctcaaaaaaataaaaaataaaaataaaaacgctgatagaagggcatctcttcataacactaactgtcccctgactacctcaacctaaatactccttcttgttttctttttcctactttagtataaactcagatactttaagacaaaaggggtacttctttctctcaaaaagaaaggcataaacatagtgtcctaggcaaactggtccttatgcttactataaatcaatccaagacaactaactatcaaaaggaacagtagaatattctttctggaattttaacagaagaagaagagccttccctgtggattttctgagtgatatatggattcaagctctttacattctggccctgtctgccttcttaaacgtatctcccttcttctttttctaatattcctgtcacattgagctattctctatttcttagacacagtctacctctctgcctttgtccatggccttaaatgccttcccagccacaatctagctgttgaaatctcatccatccttgaatatctagctcatgtaatggtaatggccatagaacagcttctactaaccacccccagcaaaagcaacctctttctctctcatgtgatgccttatgacatttatttcataatcttgtcacatcctcactttatgatttctcgtatgtaatttaaaaaattacataatatctaacctgctagtttgtaagttctttgaggacaggttctatgtcaaattcatctttgtatattcctgacagcctagttacaatgatattaatatattggagtcacagttgtatttctagagaggattatatggctgaacaaaatgtttcacaatgatatgttcttctgatggaattttttaacctaagattactgagaatttcttggtcagcaaaaagacaggagtatatcattctgacactcttttgaggcacatgtttattcaatgtccaccctctcacaagcagatatttaataattaaaaaaagaaaatctgcagcttgattatatgcttagccaagaaattcttttgcagttctaaggaaaatctccagcaaacccaattactctcccagcaatgcacttcaaaggagagcagaatgcatttcttgtacagaattcctggatatgtttgatcattagttagggcaagtagtttgacttgaggctatttactcagcaggaataaaaagtacagcattgcttcaaccaagaggagtgccccataccttccccaagcagaatttaataatttgatctgtcagaggaggtacagaggttggctatagaaatgagtcacgaccagtcagatttggctgacttgtgggccattaaaaatgttccttcccccaaacggcattttttaggaataataataacagaaacagttggcaccatgtaattgaccaagaacctgagaatttcacagcagtacttatcactgaaacagtttttgtttttttgagtctaagccaaatccacacttgagtatttttttaatttatccaggtgttctatggctaatatttatttcatctagcaagtgccacaaagtatttttgatgtagtcaaaaaaagtatttctgatgtagtttaaaaaagtatttttggtgtagtcaagaatataacatgatattattagactcctaattacaaatatttggtagagactatcagtttaagaaaaaattgcattaaaatgtcaacttttttctttttttgagacggagtctcgcactgcacactgtcacctgggctggagtgcagtgacgatctcggctcactgcaacctccacctcctgcattcaagtgattctcatgcctcagcctcctgagtagctggagttacaggcgcacgccaccatgcctggctaattttttgtatttttagtaaagatggggtttcaccatgttggtcaggctggaagttttttcgaaaactaaatatatatttcattatataaggtagactttacactttttgggaggaaaatgcacatcaccttttaattttttttttgagacggagtctccctctctcacccaggctggagtacagtggcacgatctcagctcaatgcaagctctgcctcccgggttcacgccactctcctgcctcagcctcctgagtagctgggaccacaggcgcccgccaccacgcctggctaattttttatatttttagtagagacagggttttgccgtgttagccaggatggtcttgatctcctgaccttgtgatccgcctgtctcggcctcccaaagtgctgggattacaggcgtgagccaccgcatccggccttaatatgtaatttttaagcactttaggttttaattaaattttatttcagttataaaaatgttcattaccatttggcatattcctcagctaaaataattaacaataattaaaattacccatgcttgattttcttatttcaatttttataaaagttatgccttcagtttatagaaaataaagaaacttatgtacacatcgatgctttagacaatatctatttttcaccatgaatatcactgaaagaaacaagtatcttttcatctttagacaaaagaaaaaaaagtactagtgtatcttttattattggttactttaaaaaaagagtaaaactacttctgtaacattaatttttaaaagttaattctcatattctaatgggagtgtaatgagtttttctcacagtgaactctaatgagtttaggaacgtgctgccatatttatggtagagactatgcaaattggactgatgtttatttatgcatttatttcatttgggaatctagttttcgaccttaagtttgctggagaatttgttacaggaaagaaagtgtatgaagaagtcttcttgtcccaggtgtggaattaaggtaaaattaacaaggaattgaagttatctttgatcatgatttttgattccatttttattcactttgaggaagtgttgcctgttttttttttttttttttttgatgttcagcagagcagtacaatgcaacacacagaagcataatgttgaattttcataataatgtttgtgatgcaaatgaggcacacttcaaaaagtagaatgattagcatttcttggtaagatgacagtccccccttttaaaaaaaaattgttcattagttttatcaatagattacatatccagatttcaattttgagtgcatactttttgcttataattataatgtgaatttaaatagttttagattgtgcatttaaaacaattcttctgtcactgtattatactctgaattaatgagctgtttgccacctcagagccctttgctttgaaattcagtccagtttaaagtgaactccaaccatttcaggccagcagctcacagaaggttgcaggattaatgagctccaggggctctgtggcttccttagaagcatttatcactaaattctattcttagggaatatcatccttatgcaagaagatggggagctgaatgtggaaaaatgctattcaaacaaataatttgataattgccaatgaagagtgttctttcttctcactacagatgaaatacaagagatgcagctaagaccagagcttttagtttctctaactggagtgaaattaaaattgatggatattttgataagattactaatgtaggtgaaacaatgcttccctatagcttgttctacaacactgtactcattcacttactggacttcctagggcttacttaaagaacttgtacacatccactgtcaaatatacttctgcatacatatactcttggatatcatagcctatttataaaactgtatctgtctccctagttatcctgtaggaatagctagtgttttctctccttttagatcttctcaaggcatcctctgagtttataaaacagagagtaatatgggtgagaaagttggcccttgctctttttttttctttgagtatgctgtttttatttaattctcacaatatctggagatagtaatttttaacataatgaaacagatttagagcaagtgcatgacaagtaaaaagcagggccggaatttgaatccacattcatttgactctaagcctgtactgtctgatatagcaagcacctgtagttattgaccacttgaaatgtggtgattgctgcttgttaaaatcataataatttcgatatattcatgcaaataaatatattactaaaattctacctagagaggcatttcctgggagctgacaatcccctttttaaaataatgattattaattttatgagtagattatataatcggattttcatcttgaaggcaaactgtttacctcttgggagagtttgtgtacctgaggttgtgccgtctaattagggcagcctgggccaaggatggtaaattcatggcaatcacatggatactccacatcctccggcagacatcacttatcggtcgtggcatttttctcacaggaacagcattctgtctcactgagacacagccttggaattcttctcagtactgttcattgatccaggcagcccccacctcttgactggagttggcaagtgagataaacatgttagctgactctcttctggtcagggctctttggcacagttaggtgctctgaccttttgaatagacctgcaaaatgcaagcctatcttcagctttcaattagatgttaggatatgaaaacatgggcatctttaaattgatgaaatattcagccacttcaggtctgtttcttcccagctaatcatgcttgtcatctacattttattccaccaactttattcaggttttacccctcacctcatgattgctttattgctagaatgtgaaaatatcttctatgcctaaattgatatccttgaattaaaggtgtgttgatgttgcgactctaacttcggtgtgctggggctgtcttgcagcagtagggagtgaagtctaggcctaccaagcattacgtgatgtccttcctcaagccctctctcagccaggcacagtggctcatgcctgtaatcctagcactttgggaggccgagacaggtgatcacttgaggtcaggagttcaaaaccagcctggccaacacggtgaaaccccgtctctactaaaaatacaaaaaattagccgagtgtggtggagggcgcctgtaatcccagccactcgggaggctaaggcaggagaatcgcttgaacctgggaggtggaggttgcagtgaactgagattgcgccagtgcactccaacctgggtggcagggcaagactttgtctcaaaataaatacatagataagtagtaactctcacatctaaagagcaagagcagactgtagcagataaatgtcccaataaaaataggctcctaacccttactctggcatttgtgtttcatcgtagcaaatttggatgcaagaaagctattgaaactgaatcttctcctacacctgaagagatctattacttcaatcactccaccgaaaaatctaccaaagattaagtatgtttctctattgtattcctgcaggttaggattgttacagatcacaatgacttaatgaaatctcaatacttgtggccaaaataacgtaggatggagagccatagtttaaaagtttgaaagctttgggggtcatctaggacactgaaattctgcttgcaacttgtttagctggaaaacaaaaagcatgaagataagactggaagatgaacatctcataccatcaatatatgggtgattagaagctctacaacaattctaaaacccagcctaataaagtatgaaacattctgaggaatgttcataaagatatgcaaatggactttgaaatggaaaaaatgcaaatcagttgaggtggcacaggcctaatttacccattctctctcagggaatatcagagcttcacacatttaacaggaaatgtacacatgctgacttccttcaggtgaaaaaaagattccacctgcaactagtattaaatatttgagatttgtttgccactgttgtatcacagatgcttcaactagagtgtttaattttcacacatataccatttaggagctgtttagtcctctccctaatgaaagagagatgggaaatccaggacaccccacacttactggtaggtttccaaatgttccgctcttagatgccactggtacctctaaataattcaaaatatcgaagagctgactccacacagcagaatgtgttttcttagttggaattaggtctataatcagacagagatgtcttattagtcagaatggaagacaacggactggtaaatattataatttgaaaatgttgatataaaagaagcctcaacataggaaaaggtgacatgaatgtcaatggcaattataatatataaaaaagataatagtgttttagagagtgatgaatagctgtgggaggaagagttgaggccagattttgcaacttctaattttttttttaaacctagcattgacagtacagtcctgaattgttgtgttgtgataggacataccttttgctattaaaaaataaggcctcatattattattaattttttttggccttctgcctaggaaaagaagtatgtctttggaaataaaaatacacaaagtaagttgtcattgagggaaagagttaaaaagaatcacttaccttttatgaattattttttaagactacacaggtgagttttttggttttggaaattcttgaacattttgatttcattcttcctggagagccaccgatactggaggctggacaccacataacaaattaaccgtcctctttcatttgtaacctccagggagataagatcagtttagttgctaatgaattttggtccccagcacagaacaattacaatggaatatgaggacggtttcaagagcatcaggaagattttaccaaattctatttaatctcctctcaccctgtttacaggtcagcttattaaagttgaaaattcctggtagatggtttccatggagagagaaaattatctctttagataaactattctagggttaatttgattcaaccaacatttatttagagtttcacatgtgaaacacaatactgtcttaggagctacagggatactaagatgaacgtggaaaaaaatgattgcccttaattaagttggcatgaagttcatgtacacaaagatgtacacggatctaggataaaatgtggcaagtactatcatgtaagtataaataaataaaaaattgtactcttcatacaaagtcttgtttgcccctcataacaaccctatttgaagagataattattcccatttcacagaaaacaaaacagtgtcataaagcagcacatctggtaagtaaagccaggacttgagcccacgctgtataccagccatcccacagagctttcttgatgctagggagaagccagtaataaagcatttcatagagaaggtggcatggtaatggaccttgaaagacaggtgtcatctcaaaaggtggccagaggggacatgtcagagagtcatgcatgaaagaggaaatttaagctttaaggacaggacagatgagacttccaaggggagagcagagattgggaagagcatctgaaagtgagccctctggaacactccatgagggatgggagcaggcgggaggaggaagcgcaggagccagctaaggagacagggaaagagcagtctggccgatgtgagatcatcttggacagcgaggtggccaagaaaccaaggtacaacagtgcagaaaatcaaagaggcccccacagtagtccgtttcagagagaaagatacacagagctaaaaggaccccaagagtcttcttgatctgggggtcactggtgactatagaaagaatagttttattagagtgatgataagccatagatcatgggaaaaattgcagtgggcaaaggatgaagtaaaaggggaagagggtgacatgaaagttgatcactgtttcaagaagtttagtagtggaggaaagagggaatagtggtattagttttgcacactcacaagcccaggtaggatcctcattttggagagcctctggtaacatctgataagcgagcaggccccttaggtggctctgtgacagagcttttgttctgaggatgccagcatgaggccacactttagtatcaagtcacaggacccctgcacctttgtgtgtcagcctgacctggggcataggactagagggcaatgggaaatcatacttgtccagttggaagcaaattttttgcagaaatttgctttcatggcttaacattcataatgccttaggttgggaaaccacccatgcccatttatgggccatggttaattctgttttattctgttcaacaaacttatccctaggtactctgtgtgaagccccactgtggctcggagtctacagcatgtttcaaagacgttgctgtcctcaagaaacataatctctttggggaagcaagaagcaaaagtagccctttactgtagtctgatgaatgttgccgtgtaggaatgggtgaagggcctggtcatagaaggacttacatatcacgcttggcactcagatcttactctgtagataatggggaaattctatagtgttttaataggaagcagcttcactgttttcatttattctcactgaggtgtgaacagtgtgtgtgtgtgtgtctgtgtgtgtgtgtgtgtgtgtgtgtgtataaatggggatagagaagcaagtttgtgacatataaagcaacagtctagataagaaaccttgaccttaattaggccagaggaagtgggtttggagagggcaggtgacacttgcttttgttagtgactgaattcactaacaaaaggggtgcggaagagttaggttgcataggtgcttcctgggttttttctggttgactggaaatgctttcatggcccgtcttcctgtctaaattaagatgttcatagatgttttaaaaatagggtggagtctggaggtagaagacaaagctgtataaagtcaaagtagggagaaaaaaaatgaagaaaggcaataaagagaaatagagacagccagtaattatttgctgtcacaacccattcttaggtcacctttcggtttcagttttccagcaatacttttctttttttctcctcttttcattattaaatgccttaagaaatgagtatgctgcatcgatagagttatgatggcttacatgagaagagcttctgagaagtgagttcctggaagcactgtggtggtggccaagtatttgcttataagattttatttgacatctataaggagaaatatacacaaacttttttgttttgttttgttttgttttgttttggtgctggaagtgggaaaagtaacaagaatttaatgagtaataaggaaatgtaagaggaaccattaaacataactatagttacatggaccctacttactccaagtgtattttagttagatttgggtgtattttgtgtctgttaaggcaggtgggcagtttgttcatttggctggaatcctggggcaattaggtcagcattaggggcttagtatttctgcaggccatttagttttaacctgctccatgaccccaggacactttctacctcatcattaccctgatttttgtccgtgagttcagggaggcaccaatcagagaatgtcgatagctttctagcacatccatcttcaccaggagaaagctgtggtcagataagtaggattcccctttacataaaaagaacagcctgttccatcgttagaaaaattagaaactgcggtgagaagtgcaataattagtgactactgaatgcttgttcttgaatttgctttataaaaaatgggatctgggagccttgttaattatatagctttgtaagaatagtttttctataactgtattagtatacttaatcaatgactcatagaatactggtaactaatagacctggacttaacgcctggaatgtcctactaagcatggtttggtgagctgtctactttgattctaggatagtttatgtttaattatgccacaacttgggcttatgctatgtcttgatgtaatgcaaataaaatagattatattttacactacaaagttcattaaaaaacaaaaacaaaatccttaagcttgtcactcaaaagtaaacatctgtatccaatgcaggaaagaatgcaggtttcgtggggactaaaacaacactaaggtgagctctctttaagaaaaagacaaatgggccgggcacgatggctcacgcctataatcctagcactttgggaggccgaggcgggtggatcacaaggccaggagatcgagaccatcctggctaacacggtgaaaccccatctctactaaaattacagaaaattagccgggtgtggtggtggacgcctgtagtcccagctactcgggaggctgaggcaggagaatggcgtgaacccggcagacggagcttgcagtgagccgagatcgcaccactgcactccagcctgggcgacagaatgagactccgtctcaaaaaaaaagacaaatgtacaatataaaattaagtataaagtggttatttaaattcagtctttcctgtaaggtgatggaattttcaaaaagtattaatagttgagaaaggtttttctccattttataactctcgattgataataacgtgtacatttttagaattgtggttaaacttgggaagacttctttaggcttctttcccgatgaactgcaagattttacagcatctcaaaatttctggtgcagggactaatcttaaatactttggaactggctgtcttcattaactagcttgttaccatagatttctcacatttgctaattaaaaaaatatgaccatatgaacacattgccaggaccccatccaagtccttaaaagggacctggcgggggaaggtccctgaagcttaagctccattgtttcatggtaaatttatctctgatctgacagcatcataattttccactgaatctgtccaaacagtattatactcaatagtccaacaaaacaacataacctttcatacttaatacaataagtcaattggggaagaattcagaattttagtgatcctaccaagttttttttttttttttttttttttttttttaataaggcacagctcaattcttatctcttggtttgactggcatacaatggcttattgtaagactattacgttaatatctttgtatcttttacaagctttaatttacccctgatagcatgaaacgagactaaattctcatataagaacatgaaaacatttttaaagatgttatctcttatggtatgtcttatagtccactgactagattagttgtaggcatctaaaataacaagtaatctcaacagatagtatatagttaaatagaaatatcgtatttctaagcaattaccttgtaaagagaacccttaacattttaaaatgttgttatttctaagcctaaaataaaatgcagcttgttatttaaaagatttcagaagagatataaagatcccattgcactttacatggctttgtgttaaatttatcaagatccattatattacatgaaacatacttagtttcattaaagatgcttgagcctctctcttttttatgcttcctgccccctctatgtacacaaattcagcaacctaatcatgttgcctttgatcaaattttatttgtatttttccccagtaatgctgtctggtggcagttaaatagaatttaattaaaataaatattcacatgctttaatagagattaatgatctgatttgacttagtaaaatttggcaaaaagtctagacgctgtaagatatacctatattacttgacttggataaaggtttaataaaacacagccagcattcaaaaaaagggagaaatggggaaatccagttataaaagctatctgagcatttagctagaactatgcatacacaaacacgccctattgaatttgtgtccacaataaaaattgggctgtttcttgtttttctattttattacaaccataaaatgaaagtgtgaataacaaggcaatccacttgttaagtggcaatttggattgacaagctattttcccaaatttaatttctggatctgtacttctcagcctttaatgtgaacatgaataacccaggggtggtgtgaaaatacagattcagattcagcaggttttggacaaagcccaagatactgtgttctaacaagatcccaggtagtgtccatgctgctggtgtgaggactgcaccttgagcagcaaggtcctagacagtgaagtgaagagactagatttgggatggttgccgccaccatcatcaccacaattgtatggataataatatgtaaatgaccccacctctcaaatatacagtcctttcacatatttccatcatctcattttggtcttcacaatatataatgtcacatgcgtatctcagcctgagtgccactgcttgtaaagccaattaattacataagaatattaaatttcagagtcttaacccatatagtccagcataaacaaagcatagctaggtttatctttccaaagggtattctccaaatcttgttattttctcactcaagattcatccagtggaatatctcctctgctccccaatcccataaaccgttatccctattctctctctgttctccaaggctgatcatctcactgtcctccacacagattagttttatttatgaatccaaattctgcacatgcagttgcctgaccaagaatgctcccacttatatctcctgctcttcatgaaatctggtaaactacttcctgcacacacaggcgttgaggggcctggccccttatcatctgacagacctgaacaaggtgaagacactctagagctgttggaattgttctcatgtatgctgggagatattttttagcttccttatgtgctgcattttaaaacaccctaacatttgtgcccattaactcccaagccctgtttcttttagataatgtatcaagcaaatttctatagttgaagttctgaagtgtgacaagggagccctgccttagcacacatgtccagatgttgacactacaagttataagcagccttcatttacaaaattcagacttaaaagccacgaagtgaataggtaattaatgcggaaagtggcaagatttgatttaaacagaaggagccattagacaattaaatactaatttaaaggaattctcacattaagttcaataaaattaaacattaataatgaacaattaatacctttgtggagttatttagtcaatagggaactgtgctttttttgtttgttttgttttgttttgttttgtttgagacaaagtctcactcttgtcgcccaggctggagtacagtggtgcgatctcggctctctgcaacctccgcctcccgggttcaagcgattctcctgcctcagcctcccgagtagctgggattacaggcgcctgccaccacgcatggctaatttttgtatttttagtagagactgggtttcaccatgttggccaggctggtctcatactcctgatctcaggtgatccgcctgcctccgccctccaaagtgctgggattacaggcgtgagccacagtgcctggccgaggaatgttttatataatagtcccacttgtaggatatttgttagaaagagagtcacatgatacatttttatcactcttatctgctacttagagatttggcacctatagcaaggtgataaatacgccccaagggtgcaactggaaaatgtggttaacccgatgcaggagtctgagtggaactctgaacaggatgagacaagccggcagtgacctgttgagcccttggaccccagaatttctcgggttattgtttctccgaacagccactcagaagagattctttgagttgatgcaaaaatctcaaaacttactgtgtgactttgtggtagaaaagaaaaaatgcaatttggatccagattacaaacttgattgtgaaaaacaaaaacaaaaacagatagtccttatgattttggaatgatacagttaagggtggtgtaggagatcaaataaattatcctttaacatccagactataagattttgacttctacctacccaaagcacttgggtcagtatacgttttagtgcactgatgcatccacttgcccgtgtgaatgcattaaggacaggatatcgtattcttctaagcaaaaagattgcagcatactctacgcacagcactgggtagaaatcccactattccacttcgtagcaatgcgactttaaacatgttttcaaacctgtgtgagccttagttcatctgtctgtaaaatggtgataatagtagtactcacctcaaaggttgttgtaaggattacatgagtaaagtgaaagttttgatttaggggaaaagaggcagaacatgaagtactaatttaaagaaatattcaggtaaagcctatgagattaagtagtcacgaatggttaatacttccatgcagtgccatctaatagggcttcactatgatgatgcaaaggcatgagaatgatataatggactctggggactcaaggggaaggttgggaggggggtgagcggtaaaagactacatattaggtgtagtatatcctgcttaggtgatggctgtggtgcactaaaatctcagaaattaccactaaagaacctatccgtgtaaccaaaaccacctgtaccccaaaaactattgaaattaaataaataaataaatagggttcactgccaagcaaatagaaagcattctataaatgttaattatagaaagtgttctatttaagtgttaattattataataatcatgattgctggtgtggaattaagaaaaaggcaagggctgcatctttagaaatgctttaattcatgtaaagtgcttaaaacagtgcctgtgtgcatgtgtgcttcataaatgctagtcgttgttattataagagttactatgatcatgctagtgctcatccttacctgacttctggagtacccatcatattcaatattccaaaagataaacacaatactatttgttggatatttatcttttaaggcaactattaaaccattggaatggtgattttctgagagattcttcttttttaaaccattgacaactttattctgctattgagattttttttcagagccaacatttctttcatttataattctactttggaaatgcaaatgttatccatttttccaatgcatagtttcaacttactagttagctctgtaaatatcatttatgagactgacccatgttagatctttgctatggtctgtggtttgcaataattgtcattctcagttcccttaagtactaaataggagaaaagacagtagaatgttaaatcaggacaggggtctttggaggtcactctgtccagcatcctgattttttagataaggagacatgacttgtccagtgtcacctagcagctcagaggcaaatccaggacaacattcttaaaggtcatacattgaccctctgttaaataagtgaacacataagtatatccattaatttcagattgttttaagaataaaaatcaaagttatataaggttcctgaataaatctcatagcaggagggagaccatgtgataaaaccttcaaaaaaatggaatatattgtctggttgcttcctgaattgtacaggttactatttcatttctgaatatggcctcaaataaattgaaaagtacatcccttaaatccttgtcaagtgcaaggtctgtgtcataaatgctttcaatattgagggggaacaggacaaaaatttaaggaaaagaatttatgcaaaagattgaatcaatgctttttttggataagcaaagcaatctgtgtgataattctactttcctcctcccctttgtgaagctgggtgggggtgggaggattagcaagaagggaggggcctaatttatggcgagagtgagaactcttttcaagcctgtgggcagaaaacaccgctgcacctccctcccggctggaacctgctctctgtgatctgggactcctccgggtctctgtttgcctaattgcaacttgtgcttatgccctccagttctcactggcccctttgatgcttttcagcaagtcctctgaaagcagcaggacaaaatgggaaggtaagcaatcctttcacataaaagagggcagcaaaacccaggtggaggtccctgctgagatgctcccttccaaggctgtgaccacacagcctaagcaaacactgtgactagtgccagcaaatgaaatttacagccctcttaacctgcaagccacagccagcatctcactccactctccaaaataaattcaacgtggctattttagaaaacatacttatcccaggttttccttttgggcatctaaggactgaattagatggtctccatctctaactacatccccattctggagactttaaaaaaaaaaaattgctttgtttatttatgtgttcatctcatgtttatcagttcagcagttcacagtttttattctgttatataacaaaggagcctaacaaaggatcacaataggaaaaataatttaccccacatggttacaatgaagagaatttaattaaaggaattgttacaaagtgtgggcagcattgagggaactgacacaagatgttgagccactcaaagactagcaactggtggaagccgttactacccacttaggcctacctaaatgggcaatgggaagataatgttaatggagcccagtgagctctagagcctcggaggaagggcatcctgcagagatgttgttctcagtcttgtctactcattggaatatcagggaaacatactaacagctgggttccacgtcctagagattttgacgtaatgacttttttttgtggtcatcaagacacagtcatagaaagacacagtcactgactaagagacagtggcaaagctaggaacaaacaggaaagaaataccctgaccttcctctcctactctctgatatcctgctgatgcctccaattagaagccagactatgagggagctgggggaatgcactctgcatggatcaacctcctgtagtctatgtagtggggaaaatgggtgaataaccagcacagagctcacaataaaccccacaaacagcctctgtccctcccacacacaaccccaggaattagaaggaagggcagactggcactttctcattaaggtaactcactcatgccatcttggcattgagctgggcacttttaggtggaatgacctcccgaagggctaaccccatctggcacctcttgacaacgttccttcttaatatcagtggctctcctgctgctggccaagcaggaccccaaggtccactgggatgtacatacttatggtattatgctctgcaatacttgtgggggctgtggaatgcacacttccaaagtgaaataggacattggaggttttatatataaatatatatatatatatttatatatatatttatatatatatatttatatatatttatatatatttatatatatatttatatatatataaatatatataaatatataaatatatataaatatatatttatacataaatatataaatatataatatatataaatatatattatacataaatatataaatatatataaatatatataaatatatatttatacataaatatataaatatatatatatataaatatatataaatatatatttatatattaatatatataaatatattactatgtatatttatatatatttatataaatatatataaatatatgtaaatatatatataaaaatatatattaatatataaaaatatatatataaatatatataaatatatatataaatatatataaatatatatatataaatatatataaatatatatataaatatatataaatatatatataaatatatataaatatatatatataaatatatataaatatatatataaatatatataaatatatatataaatataaatatatataaatatataaaaatatatatataaatataaatatatataaatatatatgtataaatatatatataaatataaatatatataaatatatatatataaatatatatataaatatatatatataaatatatatataaatatatataaatatatatataaatatatataaatatatatatatatatttttttttaatagagaggatgaagaccaaagcagtgagttccacctaagctggcccttgccttttgtctaacaggaaacccagtccttcctaatgggcacagaattttcagagaagagagcagaagttgagttggcatacctactgtagtgagggattttgaacaatgagctgtacattcctatatgggagccaaacttttagttaaatagtaatacaaaaatgctgatgtggatgccacggcttcctcctttcacacagaagatgggcagtgactacacatttaggttcaccttgcatgaagccacgctatagtttctaataaggtattattagtattcactagccattctccaagggttggcttcaaatgagatcagtaaagcagaagcaaatcacccacgggttctttcacagtttctttcaccctaagcctctcatttcactagacaactgtaggaagaaaaacgagatccctgaagggcagcaacttttcataaactgcacttgcagttttgccaatgcacatatctgtgggctcattgcacaggcagcgcttatatctatgggcacatttcacattgtagatttcttgtcctttctgattttctccccgatcacactgatacaggccacttccagtgcctctgtaaagctccaaggggtaaaggagggcaggggtgaggagtaaaggaacgattcttacaggtgttgtgaacacgactattttatatcaaatgcttctaattgaatagtttaacttaaaaacatgtatcacaaatacagtttgaccaactgtaacaatatcaaagcatattgaacaggaagtgaaagtctttgggtgtggatagagatttccagaaaaatatagttacataaatgtgagtttccaaattgtaaagaagaaaaaagacatatctggcttaatatatataacattaatatcatgcatagagattctattaataacatttgtcagccactattgctaagagctttacatccattttatcctcacatcaatactattaaagaggaactattattatcttcatacgatagatgaaaaaacaaaggctgtaagagtttaagaaacttgtccaaaatcatgtagctagaaagcggccaagccaggattcagaccttggttaacccacttacaaactctaaactcacttctccattgttaaacttgactagtgcattggcttacaatgaagtttgccatattcttccctcaaatctgtatttttaataagttgctaggtgatttttatggtcaggagaagtggggccatactacatgatgtaggctatttcctgagtatagataatttctttcttttcccttaggtgtccattttctaaaatgtggatgagaacactctctatgtgtcctgcaaaatttaaaaagtttccattttaaaatatgttttataaatactaaataacatgtccttttcttgctgcctaagacatgattattggtatgaaaatgctatgagaagtcctatagtaaagacatttttgtccagagaatctgacttttgtctttctccagagaaagcaacctgacttttgtcttttaccaaataatatctgtttgtgtatccttcagttgtgccctttggagagggctatttctccatgtaacttcatgcagttacaagtcctatgatagctttatatggatttataaatcagtaaatttttttatactgtaaaactttaattttaagatttcaatgtttttattcattttgaacatatagggtaataatatcttctgaagccaggcaaatctactattaaattttgctttctataaaaacatagttgttagataactaatactgtgcgaacaaatttcttttccctatagagaaatagtgagtgttgaaccgacggaccttgtctttagaataaaaagacttataaacacttgtaggccagctccatgagaatatgccagctggaggaattttagtgcttctaaagataactgagaaagcagtggctctgaaggttacctttttctgctaatggatgtttagatctaaaatcccagtttgctttaaaaaaaacagtagtatgttaagaaggtttctagacctgtgctatcagtgtcaatgtaagtcttataagttccctatgagaatgttaaatcacaagggcttagggtatataggagttaagtgatgctttcagttgatgttgaatttcatggtgactccagagtcacataatataggagcttccaagcttgacaaattgctcatatatacgtaggcagaagtggctgatcactacagtgctggtcctgggcctgtttggtttgtgtccattcttgtctttcccctactatgctgtatcacaggggaacatacctcccacaggctgcatttcccagcctcccatgtctgactgctaacagttgggtcaatggtaggcattgtcaggagattagagggcagaagaaaggagaagccagggaatttctgccttggcaacgtctctgcctccatgatgctatctcctgccagagaagcctaccaaggttccagcttactccatgtaaccctggtccctgtgctctggtgatgctacctcttctgtgtgccctttgtggtttcctgcctttggtaatccctaggttgactcactgctacttatttggcttttttttttctctcctattacctataaaccaacaccctgtgttaaattcccttaagttactcattggtttgtgttctcctggttgaaccctgattaatgaaatttccatttaaataccaaacgtttcctggagttcgttattctagtggaataacaaacaaccagctccatgaattgatggcttttcagaatttattgtctccacaatatttgtttcaaatcctcttttaataatcactattttaaaacttaattactactactattgataataataaatgtacccttaaatgtattatataccagatttggatttgcatctgtgtgtcatatgctcttagttcaactctttctttattgctcacctgaaataaagcttcttttgccagttctatttaattaaagattatcctgtgatgagaatgcaagcctaggttctgccttgatttatatggcactgctttttcttcaaacactaagtgatttgtagcaagttctcaaaaagatgtgcttgcaactttcattttctaaggaactggaaggcagccataattttctctttgaaagttccacctctgttagagtatgtatagaggtcaagttccaaaaatagcttcataatgtctgactcccctttaatgcagtttgattaatctttgtgtaggattcctggcaaatgataggcacaaaatgactatatatgaaatgaataaatgaatgaacaaataagtgaatatagcaactgtctctccatagttatgcatacaattagctattttttgactcaaaattaaccaggaaaaacttaagttatccttccacaaggtgaacttaactggatgtgtcttggtttgaaataccagcaaccagctgcatactgtaggagctatcagagcaaaactcaggtgttgacactaaagattaatgaaccacctttagttaattgatcacatccaaagtgcactcccttcagccttttgtctgtcagttggcagagggtccagcaggtagacacactccattgctcactgaaattaaaatttaggtaatttaaccttctcaatgctatagatgatgatttttttaagttgcagtggaaacaacagagcaatttctgggtgagtaggtcttcttggtgattcataatttagtagatgacatgttcaaatttattaagttggcctgagcataaaattgtccaggagaacaacagttaatctacaatgctgcagaggtatctttcaggaacaatacaatccccactactattacatattgggctttttaattttaggcttgcaggtaaagagtgagcttttcagtgtttgcttttcaatgatatacacgtgcaggagtaacaattctagtttttgaatgtgggtaggaaggcatgcctgagtgtttatccggggagtaagcaattttgtacatagaatgtaagttggataaatatgcatttgctttaggttaaggtgttaatgcaaccttgtcaagaagaataaatctgaaaagtggttaaatcaaagctatttgattttaaagaataaaagtaccatctttcaaacgatattatctttgtctaacagtaattttcccccctgcctgtaatttcagagctctgtgatgtggaagctgtcaatgttacgtaactgagagcaatctgacttctgtcattgtgtgcattcctcaaggatcgtgtttaggtggccctacttgatgcttttctaaaaagccccattctacttctaagtaaatactgagttcctggagaaacctgatgaaagaaggcataattttgatagctgctttgtaaatagtaggaataagtatgtggcattattttctttgagggagaagaaactttttatttgggtgcgattcatatgagaacatacttactgtagattttgaaccttgatactggcagtgtggattggcctgtaaattgatgcttttgtttctggctgaggaactgcaaatatgccaggtgacattctctttgaagtgtaaatgttgtttcagttgaattttttttctagtacacttggaaagtgagtttcatgcctatgaaagagtctggattctaataaacattattcctagacacaggaaagttgctataagcgatgggattttgaattctacatggattcctgtttaacaggtgacttcacaccttaaccttgaccagccttctatctacatctgccatgttgatttcttttgtatattcatttcttgttacttccagcggtaattacatttctaggatatattggtgtattttggttgtctccaagtccccttggattctgaggccaccattgtcctttctagacaaatggaatggcttaagcctccacacagtgcactttgggaggtcctggattgtacttgacatttccaaggtgtctaaaaagtctgatattgtggtgtcacctctttctccaaattcctgctcccagtttcatctttaatgaccgatggtcactttctgccctatcttgcaccatctgcctttaagacacccctaaggcttatacctcaatcacaactgatttttcctcaaagttcagtgaaggagagggcaatagagtgaagaatttgttgctgtcatccaaatataaaacaggaaacacattatattttaatataaaagcattattcctagaaacatattagccattctctgccaaaaggacattatcactgaccttatactttattaggcccccaaacccaaccatcttgagagggttccatctctctcccatatctttttcttttttctttctttctttttttttttaagagacaagttctctctttattgcccaggctggaatacagtggtgcaatcatggttcactgcagccttgaactccttggttcaagggatcctcctgcctcagccttttgagtagctgggactgcaggtgtgtgccaccacacctggctaatgtttcttattttttgtggagacagaatctcaaactctggagctcaaatgattctctcaccttggcctcccaaagtgctgggattacagacatgagccaccatgcctggcctcccatgtctcctgttccagattctagttccatactattggccactacaataagaaaatccttgttattttattaagcagatgacttgagctttcaaattctattccagcctagagtctagggcccaactttgcatactggactagaatcattaaggtgttttcccttttcccaaatgcaaatgtctttactttcacaaatggatcctcagtaccatcagaaaatttgaaattgctgtgttttcctttcaacatattacagatcacattctgatagctcctcctcaactcaataaagtaaacatcatggttacaggcagtgtgtgggtggtattggtatgtcgaaagtgggtgcagaatgagactgtatgtattgccatattgaactggagaagcaaaatatgttaaagcacctggatatctttctttgcatatctctcctgtggttcttggtcaaggactatcgttgatacaggaccagctatgtaagccggagggcacagtgcaaaattaaaatgtggggcccttgttcacaaattatcaggaactccaaaagatcacaacagagcactaaaaggtcacaacagagcaccaaaccttgagtggccctttctaagcacaggtcctgtgcaatagcacaggtcacatacccgtgaagccagtcctgtgttgatggttgttgttgagtgagattttaatacatgtatatttatagtctgagatgcatttgactgccacctttggagaaaatatgtgctagagtagaaaaaataatttgaatggcagtaacaaaagattggttgccttgagaagaacattcttttgtatccgttagagtttcatcagagaaacagaaacttctctagagtttaagttggaaggggttttatatatcaatgaagtatttctaaaactgttggaagtgttagaggatcaaagctcaaggaaagccgtcattagctttcagagaccctggaaagtgtaggaaacccacaaaatcattagtgatgtccaggcttcctgcagtgctgtgaaaggtgattttcaccaaagccgtggcgctgcctattcctgcacaggagcaatgggttgctgtcaacctctctccctctttctttatcttgcataaatcttcttgttgatgaaatttaaaatggtaaataagcatttaaggggatctgactgctacagctagatgggaaagccaaaccccttttctcaacaaggaataatttgaagaaattggattcttcattgttggtaaagtagtatctgccatttgcataaatatctaaattgtagagagcagccattattagttaaagtaaatgctacatgctataatagataaacactaaaatctcaatagcttaatacaatgagattttatgtctcgttcacctcaaatttaaagagcagctgggaagacggcagtaactgcaccatacaaccattcaggaaccagggctcatggaggctctgctattttttaagcttttattttagttcaggggtacatgtgcaagtttgtcatataggtagacttgtatcatgggagtttgctgtacagattattttgtcacccaggtattaagcctagtgcccattggtgatttttcctgatctctttctcttctcacactctaccctccgatatgccacagtgtgtgttgtttctctctttgtgtccatgtattctcatcatttagctcccacttataagtgagaatatgtggtatttattttctgttcctgtgttagtttgctaaggataatggcctccagctccatccatgtctctgcaaagaaaatggtctcatttctttatggctgcatagtattccatggtgtatatatgacacattatccagtctatcattgatgggtatctaggttgattctgtatctttgctatcatgaatagtgctacaatgaacatatgcatgcatgtgtctttatgatagaatgatttgtattcctttgggtatataaccagtaatagcactgctgagtcaaagggaatttctgtctttaagtcttcgaggaatccccactctgtcttccacagtggttgaactaatttacacttccactaacagtgtacaagtcttcctttttctcctcaacctcaccaggacctattattttttttttgactttttaataatgtccatcctgactggcatgagatgtatcttattgtggttttaatttgcatttccataatgatcagtgatgttgaggtttttttcatatgattgctggccatgtgtatgctttcttttgaaaagtgtctgttcatgtccttgcccactttttaatggggttgtttcgtttatttcttgtaaatgtatttaagttccttatagatgctggatattagacctttgtgagatgcatagttagcaaaaatgtcctcccatactgtaggttgtctgttcactttgttgatagattcctttgctgtgcagaagctctttagtttaattagatcacatttgtcaatttttgcttttgttgcaattgcttttagtgtcttcatcatgaaatctttgcccattcctatgtcctgaatggtactggtatacttgaaagagatagggggaatggaaccaacttggaaaacatatttcaatagatcaaccatgagaatttccccaacctagctaggaaggccaacaaattcaggaaatgtagagaaccccagtaagatacttcacaagaacatcatctccaaaacacataatcatcagcttctccaaggcagaaatgaaagaaaaaaatgttaaaggcagctaaagagaaaggttaggtcacctataaagggaagcccattagactaacagtggaccgctcggctgaaactcagcatacaagccagaagagattgagggccaatatttaacgttcttgaataaaagaaattccaacccaggatttcatatatggccaaactcaacttcataattgaaggagaaataagatccttttcagacaagtaaatgctaagggaattcagtgtcaccagacctaccttacaggagctcctgaaggaagcactaaatatggaaaggaaagactattattagccattacaaaaacacactgaagtacacaggccagtgacataataaaatgaccacataaacaagtctgaaaaataaccagctaacaacataatgacaggatcaaatatatacatgtgaatactaaccttgaatataagtgggctaaataccccaaatgaaaagccacagagtgtcaatctggataaagaaagaagatcatagatatgctatcttcaagagacccatctcacatgcagtgacacaaacgggttcaaaataaaaggatggagaaaaatctaccaagcaaatggaaaacagaaaaaagctggagttataatcccagtttctgacaaaatggactttaaaccaacaaagattaaaaaagaccaagaagggcattacataatggtaaagggttcaattcaggaagaagatctaactatgctaaatatatatgcacccgacacagtagcacccagattcataaagcaagttcttagagaccacagagatacttagagtcccacgcagtaatattgtgagactttagcactccactgacaatattcgacagatcactgagacaaaattaacaaagatattcagatctgaactcattactggatcaaatgaacctgatagacatctacagaactctccactctgccattttcaactcatggtttctgcagttgttgtgagcattgacactagttggcagaaagggaaagagggagagtggaggattttatggcaaatttttatgggctaaacctcagagtggcacttgtcactttttcccacattgctattgccaagttctggtcatatgaccccttctaattgcagaggaggctaggaaaattagctacgtgctcaggagggaaaaaaagggtaaacagctagacagtttctctcacatgatgtctgacagggatccaggttgcccttctaccatttcagtaatcagagagtcatcattcacgaggggaaaatggctagtggtatgaatagcttttggtattttattaaacctctttgcttctaagtttctagatctgtaaaatgagggtaagtgcatcttataggataattttgaggattttagatttgacacaagtaaaatggtttagtgtaatacctgaaaattagcaaaaaatataggaatattacccattatcattattattttcatcactaagtgacttagtttgttttcacactgtggtaaagaactgtccgagaactgggtaatttataaaggaaaggggtttaactgactcacagttcagtatggctggggaggcctcagggaacttacaatcatggctgaaggggaaggggaagcaaggtaccttctttacaaggcagcaggaaggagaatgaatgcaggaggaactaccaaacacttatgaagctatcagatctcctgagaactcactcactatcatgagaacagcataggggaaactgcccccaagattcagttacctcaacctggtctcccccttgacacatgaagaatatggagattacaattcaagatgagatttaggtgggaacacaaagcctgacaatatcacaaaaactctaagaaagggtagcatatttggaaataagttaatatatcaaatgtgctcaacgcatgcacagaatgtagtaaaagttcaatacatgtttttatcatctaaacttattgagtcttcctggtattatacttacatttattattatgactttctactcataagaacccctcagataaatttcattttcttttattaggtttctttttagaatattgtctgtctgcaactacagtcacttggatacatcactaggtttacatgtgttttaagtcgacttttgctagatgtagcttgatctttgaggctctgtgtaggcctttataaattgcccttcatttgtttattgagaattgaaatgaaaatggaatgctccagactcagatgatgggatttgaggtggaaaatctcattaatgcataaacatgtaaataaatcagttgtttctaaaaatttattcagggccgggtgcaatggctcacacctgtaatctcagcactttgggaagccgagacaggcagatcacctgaggtcaggagttcaagaccagcctggctaacataaaccctgtccctactaaaaatacaaaaattagccaggtgtggtggcgggcctctctaatcccagctactcaggaggctgatgcaggagaatcgcttgaacccaggaggcaggggttgcagtgagctgagactgcgccattgcactccagcctgggcaccaagaacaaaactctgtctcaaaataaataagtaaataaaaataaaataataaaatacaaatttattcaggatagcatattaaacattgattgatgttggtactttaacagataagaactattttaattttgtgttcaattgagtcaaccctaatttgtttagaaacttctggaattgaatgcaatctgttaaaagtaaagacgtgttaggccagataataatattgctttaagcttgcctatctctaacacttattaggagaatatatttatatctgtctttttaaagtaagtattgaaacagctttgtttaattctcttttggtaagaaagatttctttcataacatttgcataatttttaaaaaaataattgtacaaaaatcacagaaccagtaaagaaatatctgtgacttgagggtctcaggaaggcagtatcaaatggagattcatttatttatttatttatttatttatttatttattgaggtgctgtccttttttaagagtgtatttgttcctctttttgtaaactgcagacaacttgaactgatggtgaggtctggtaagaaaaaaaaaaaaaaaaattcaaagctaccaagggagaaaaggtgaatttcattggattactaaattcacaaacaaactttataggtcatcattgaacattttatttatattagaataagcaagcattgagcaagatagaaataattttgcttcaggttatcatcattgtgaactatcacaaggtataagcacagaaatgacagaagttctggcacagaacaaggaatttgcacatggtccaataacatgaacaaaaaaggttgtatttatttatttatttatttatttatttatttatttatttatttatttttgagacagagtctcactctgtttcccaggctggagtgcagtggtgcaatcttggctcactgcagcctccacctcctgggttcagatgatcctcatgcctcagccttctgagtagctgggattacaggtgtgcgccacaacccctggctaatttttgtatttttagtagagacagggtttcaccatgttgaccaggctggtctcaaactcctggcctcatatgatctgcctgccttggcctcccaaagtgctgggattgcaggcatgagccgctgcacctggccaaagtttcatatttcttgtgatgacactgaatttttagacaaaagagatatattgactttgtgtgttgatggtttcaatttagaaaagactatttgggctgggcgcagtggctcatgcctgtaatcctagcactttgggaggctgaggtgggcggatcacgaggtcaggagttcgagaccagcctagccaacatagtgaaaccccatctctactaaaaatacaaaaattagccaggcgtggtggcacgtgcctgtagttccaactacttgggaggctgtggcaggagaatagctttaacccaggaggtagaagatgcagtgagcccagactgtgccattgcactccagccttctagtctgggggacagagtgagactctgtctcaaaaaagactatttgggaatttgttcatcaaaatttatgcatccactttattttctcaaagttcctcttactggaaagcatttaagtattttgattctttttaaaaataatttcaacttttattttagatttggggggttcgttacatgggcatattgtgtgatgctgaggtttggggtacatattatcccatcacccaagtagtgagcttagtacccaataggtagtttttcagcctttactcttctttttctcccctctctagtggtcccaatgtctattatttccatctttatgtccatgtgtgcccagtgtttggctcacacttataagttggaacatgcagtattttgttttctgttcttgtgttcattcacttaggataatgacctctagttgcatccatgttgctaaaaaggatataattttattctttttcatggaggtatagtattccatgatgtatatttaccacgttttgtttattcagtcatctattgatggccacgtagatggattccatgtctttgctattgtgaatagaactatggtgaactttttggtataacaattattgtcctctggttatatatccagtattgggattgctgggtcaaattgtagttctgttttaaattatttgagaaatttttaaactgctttctacagtttagaaattgatctaatttacactcccaccaacaaagtataagcattctcttttctccacagcctcaccaacttctgttctgttttgacattttagtaatagtcattctgactggtgtgaaatggtatctcactgtggttttgatttgcatttctgtaataattagtgagggtgatctttttttcatattttttggctgctttatgtcttcttttgagaaatgtctgttcatgtcctcgtttcactttttaatagggttgttttttgcctgttcagttgtttaagttacttatagattgtggatattaagtttttgtttaatgcatactttgtgaatattttctcccattctgtaggttgtctgtttactctgttgatagcctcttttgttgtgcagaggtctttagtttaattaggtcccacttgtcaatttttgttttagtagcaattgcttttgaggacttagtcatgaattctttgccaaagccaatattcagaatggtattaccaaggttttcttctaggacttatagtttgaggtcttacacttaaatctttaatccatcttgagttactttttgtatatgatgaaaggtgggagtctagtttcattcttgtgcatatggctagccacttatcccagcaccatttattcggtagggaatcctttctcttaatggtttttgtcaactttgttgtatgtcaaatggttgtaggtgtgtggctgtgtttctgggttgtctgttttgtttcactggcctatgcatctgtttttgtaccagtaccatgctgttttggttactgtggtcttacaatatacttaaaagtcaggtaatgtgatgcctctgactttgttctttttgcttaggattgctttggctattcaggctcctttttggttttgtaagaattttagaatcagtttttctaattctgtgaaaaatgatgttgataatttgttaggaatagcagtgactgtgtttgggcagaatggccattttaaggatatatactcttccaatccatgagcatggaatgtttttccatctgtttgtgtcatctgtgattactttcagcaggcttttgtagttctccttgtagggatctttcacattttggttagctattttcctaggtattttatttttcaggtggctattttaagtaggattacattcttgatttggctctcaggttgaatattattagtgtgtagaaatgctactgatttttgtgcattgattttatatcctgaaactttgctaaagtcattgttcaattctaggagacttttggtggtgtttttagtgttttctaggtatagaatcttacatcagtgaagagagacattttgacttttttttcctatttggatgccttttatttctttctcttccctgatagctctggctaggactttcaatactatgttgaataggagtggtgagagagggcatccttgtcttgttcctcttcttaaggggaatgcttccagcttttgcccatttagtgtgacattggctgtgggtttgtcatagatggctcttgttattttggggtatgttccttcaatgcctagtttcttgaggtttttttgttttgttttgttttgttttatcgtgaagggatgttggattctattgaaagctatttttgcatctattgagaggatcatatggtttttgtttttagttctgtttgtgtggtgaatcacatttattcatttgcatatgttgtaccaccctttcctccctggaataaagcccatttgatcatggtgaattaacttttctgtatgctgctggattcagtttgctagcattttgatgaggatttttgtgtctacgttcatcagggatattggcttgtcgttttcttttctcactgtgtctttgccagaatttggtatcagagtgatgctggctccatagaaggagttagggaagagtcccttttcctcaagtttttagaatagttacactggctcttcttttgtacacaactttataaacatacctgtaagcgtaattttgcaaagatctttcattcatcaaagagaattcctttgtgaagtaaaatggtaaatagtctaagcatcttgctttcaacttgactcagagccaaatgtgtgtaagcattgagagggtttgccattttacattccttagtctgaagaagggaagaaagagaacatccttaaaccctaaaaatattacttggcctgtatggcatttgtacgcaaaggtagaatctgagaccttgcataagatttactggaaatgctacatctccatgaaagactacatcaagagtgtcaaagcatgattagttggggcacattcatatttttttgttagggagtctatgtcctctcttttatgtattgtttgacgtcagatgcctttaaagtaaaactataagaattattagtcatttgatgagaagtaataaatgttatatagagaaacattacaaaatagagatagactcaggataggggaccatagagcatacaaccatgaacacatatcatttgcttaaattagttaaaacacaaaagcaaaatatttgaaatagtcaaaagaacattttcaattctacctaataatttattggatgaattcttttatttttttaaatagtttactggccgagttgataatatgatctatcctagttattaaccagcagaattttaatttagttttcaaggttctccatggtctaaactcaacatgcccttccaggctcaaattacactcttccagttcaaaggcccatctgaaatgggctgcttctattatgttgcccaggctttcttatctctagctctttgccctgatacctttgtctttctacttggagtacctattctttccatctttaataccccaccttcattaaatgaccctttctaattacttcctgcatgcttcagccagatgtaatctcttctctctgattatcacataacactattttgtgcttctgtggttttcaccttactcatctctgttgtactgacaaatggactgtgagctccgtattttttatcttcacccttatgcattgcgtaattaaaaccttgtacacagtacaggttcagcaaacacacactgaataaattaataagtaggtgaatagttttgttgtttacattcactaacaacccattctgattcatgtttacatggacagaaaaagaatgagttgattattaactaaatttaatgtatgtcatctgtatacctaaattctttgggttaatattaaaaaagtattcttccaagttagcatgaatttgacctatcttttagagtgttcagattggttcactcatgttgacattagtcagttttgaaattcagacataaaggtatacacatatagatttgacatttgagattaacttacttttttccagttagattatggaagagataaacaatgactcagaggaaaatggagaggctatagaggtgaaatactgtaataatgtggctaaacttgcttgagagaagatgagacataagcctgctttgttagtcctttcatagagaaatgactcagcactgttagagaatatgatgaggttacattgttctttcatcacaaactgttgagttaatggtggcatatatagagtatagctctgattcataagacaattggtcattgtgcttctctctttttattttttaaagcaaattagtgctttaaaagagcatagtaatctggttcttttcatgaaaactgatgattaaaaacaaactacgaaaataattttaaatacacctgggtttccaaatggacagaggttgttgaaagtcatttttaagttccttcaaagctacaaagtctatgtgtttctcaaattatcttttgcaaatcttagtaggaattaaacttgtgcaaatccaacccctggctctttttagcctcgtgagagcagagtatgcatcgtgctttcgttttggatgagaaatatacaaactgtgtgttgactggtggaaagcagaacaatggatctcagcaaattgtatcatgcccagctctgacttgagacgcagaatcaattcattttcagtgtcatgacaggatctgagatagaagtgagtctcttgttgccatcatgagaaaagatacgtatgtccacagttttggggagagggagcatgggagctgggtgcttcactgccaacacagcctctgatcacctgatatgttacaaaatcaattttatcttctgctgcatttcatgtgacaattcaaagagcaacatttgtttttctactctttacattctcaacttccatggaggcataattgccatgagttaaagctaggaggagagtgatcactgcacactgatttggatataaaatctatggccatttgaaagggaaaccttcaagagcccacgtaataaatccccgaggaacttaagagagatgaactgtacctaattgcatctgacatggctaaaacacagggacctctctaaagagtgtgagggcaggtccccaaatcctctgctcagcactattcaaggttcagaagaattcatgcatttagcttatctacagctatgtggcaaaacacccttcagctgcagtcagcctccctctaatgaccaatgaggagaggccaaaaattaaagttgtataatcagagattttaaagacaaactgaaaagaactggtggaaccgtctaacttatgccttggaatggcatgcattattttgtatatgattttgggcctcagaacacaaacacaactccctccacaaaggggatgagtttgctgggccagagtggcctcttgttgctgggagctactgccgcccagcgtgggcagctgcaatcacagtgcccctatccctgcctgagtggtcctggagggttggagagctgcgtgactcctcaagacctttgtcactagcctgtgtaatgcctgtgcatgagtccttgaaagcaaatcccccaattagggcctacatggcctaccctgaggagggaagaggtgcaatacatgttgcttttaacaattcttcatcaggaatgagaggatgttgcaatggaaaggaaaatattaattcctgctaggcccttgtcagtgggatcttctcccattctcttcctgctggaattacagatccataggttttggagccagtcagcctgggttctttcatgcattcccttcttctggtgggcttgaccatactagatatcaaatactgtgactcaaagttctaccacctctgttgacttaaaggtcaaacctagaacaagccttggtctctaggtctaagaggcaaaataaaagctggtgaaccttcttactgacaaggcacttgacttccctgtgcctcagacttcaaatctataaaacgagactcactgttcttatctctgaggtttattgcttggaattgaatggggtaattcataaattccctagcctggcaccccacacacggcctcttcaagaagtttcggggtagctctcttgccagtcagctgagaaaaccaagcagtgagaagagggtcatatattgacttggttttcatgctgacaggctttggcatctcctcaagcttgtccatactctacagtggcattaagagagtagtgtcctgcacttgtgtttgagcactgtggaacattcctcaggagttctggctgagatgcatgtgccccaccttttcccagaaccagggccctctaagtctaagtcaataaagggaccaggggaagttcctggaaattctgatccaattcaagtccctgctacctaggtttacctcttgcctggcctgtctccccctaatttctcaggagtagacttctatttgtatagtgtttatatgggccaacatttgcatatgttcacgcatgttatcttcacagcaattctaaaaagacaattaactcttgttatgtctgtttataaaagaggaaattgaggcacagaaatgtcaagtcacatgaacaaatccctacaggaaccatctttaataagtgtcaaagtaaggagtcaagctcaggcagtcatgcccttatcccacaaattttgagattctgccatagccaggtttatgccttgcttctcacttgtgatggactttccagagcttggcccagtcactgaaacatggcaaacattgtcaatatttgatgagtaaagacatgaatgaatgatgcttttgcaactatcccattccctgtgcactcactgaatttttcttcccctttttatcatcgcagtgtttgaaaattttacttccttattttactagatatatctttgtctttacatgtgtcatctctcaaccagatgtaaaaggtacttccctgaagggaagaagcatgttttatacctgttatgtaacctccgtaagaatagctgaatactcagtttgtgacacacaaaaaccctaaaataactatctaaatagattgggaagttgggttgttgagatacagaagatttactcttcttcccaactcatcccttctctttgctccttccaataaaatgctatttggttgaatagtttaaagatggaaaaccatttaaggttaaaacagatgaataagatcattctaaagaagcagaaaggcgttcagaccgttaagttgaatagatcagagtacggcattgattctggctgtaagatttcaggtcaccaaaggaaatatgttggattgcattatctccattttttttaaaaataaagtttagatcgctccctgaagataaaattactcttggaactatattcaagaaggacttaagtatgtagaccttatgtaacagatgtaagaaacaattccaccaatgctgatattatggagacaccaacatgccctcttacataagccataaaagtggtgagaatggccacatttttgtgatggggtgtttggaattaattcatcttcatgaaacagaggccacatcatattcttggtcatgagtaatgatggtaatactgtttctctttcctttgaatcacttacctatccattgacctaacatgttttaaataccacaaaggagtaagattctctctcatgtctttgggtagagaaatatgcaacaacccatttcctaaaaagtctgtaattacatgtgggaaatgctggtaattaatagcctgaatgggtgattctaagttagattcatgaaaaaccaagagacatatctaacctttcttaagctccagggcacatgcataatttgaacattatgtctacaatgtgggtgtattttcttccttttcaatgaagacagtgattaggatgataatagaaataatacttgggtttatagagcctttagctgaagtctacctacatggtttctggctctgtggtaagcatgtcggactaatgtcagcttttgaagtgaatttttcatgcctttttccctctgggcttcccctttctctaataaaactactttaatcccattcacattccagttctgaatactagcacttgaaatgaactgtctatatctgactcacttaaaaaaaaaagtagtttaaataaaaacaaagagttgtttactttcctttcctacctggctgcatctgtcacatgcatatagtgtcccctgacatgaagctctgatattgatctggagccttattgatctccaacttaatatagggacaatgtctaccaataacttaggcacttccagagaggctcactctgtcttcttttgttcacttacaaaatgaaaagaatgtctttactagagtacctattaaagggttccagtacaccctaccacaagctcaactttggaatctgataaaatattttttaagcaagcttctggttttgttatattaatttgggattggattccctccagtggttcaaacaaaatgaaagtatgatctttaagtatgtaatatattctgtcagttctctggttagtttggatcagaattaactcctttcaggatcatcccaaaataacagtgtaaccccatagtaaagcacactctcttctttcctgtgatatcccatggagtaggaataattaggcaaccacaactgcttaaccctgtgtggtttcacacagaaaaatcatgacaatttctcttcttgttgactctttctcatttttctggttatccatagcttttaacaacaaaccaccctaaaagttattggcttaaaacaattgcaattatttatttggttcacaaatctgcagtttgggcagggctcagcagaaaaggcttgactgtgctccaggtggtgtgagctgtggtggctcaagtgggctgaagtatctattttcaagatatcttaccaacatggctggtgctggctgtttcctgggaactctactgggtctgttgtatggggtcattgattctttggatccaagataccacagctagaaactgccactctttttcagtctggtacagcatcacttctgcgatattttgttggacaaagaagtcacaaattctgcccaaatttaagaggaagggacataggacctgtaaagcaaaataaaatgttaagcccccaaccaactaaatggatccccctcacaaccaagagcattccaaagttaacctgaaacatgagttcaggccatgatgggaatggatagtcagacatgcctcattataccatcctccctttggaattgaggcacaactgaccagcgttaatattgaaacagaaacgttaaaacaatctgttctctctgaagcctggaggcttcatctgtgtaataaaaaccttggtctccacaaccctttactttaacccagacactcccttctattcattccaggtatttatcaagagcccatctaattgccagtcagaaaatctttgaatccacctatgacctgaaagcactgatcccctactgacccaacttccatttgtcctgcctttccaggacatggaacatacatcttaatgtcaaaggcatgtccttaaccttggcaaagcaaacttctaaactgattgagaactgtctcagatactttttggtttacaaaccctacctgtcattgagaggagtgtcaaaaaattgggccatgtttatactacatgctctttaattaatatctgtctgatactactaatatctgatactatagttacccaagccagaaactcagtcatcacctttgaccctttcttctctcttatctttctcttcttgacccaccctagaaatacatgtaatctttattgcatataattaataattctgtgacttaatcagatattattgtatcatatacataaataccaattacaaagtcttctaattgaccctagaatcttctgcttctcttgagtgccatcacctctactctggtacacacatcatccctcctctacctactagccagtctctctgcctccagccttacccctttttactctagtcatgatgattttatttttagttagaaagaataactgtcctctgattataatttctcaaacatcctctattgctgtaagagtaaagtgcaaatttgtttgcctggcttccaaggccctgcaggatggggtcccagcctccttcactagccacaccttgttatctcctattgaacctttggcccttagccttcagctttaccaaaatcttgatgtactccaaatctcttcctttgaaatgctctttcctgttcctcttccttcttaccatcctccattccctttgctgggataattcagtcgcattctttagatttcaagttagttttcaattgctcacttcctctgggaagaattttatgacccttcattcatttattcattcacagagtattcattgagtatctacaatgtgccaggcactgttccaggccctggagatactacagtgagcaaaataaataaaagagccttttgtcatgggatttatccttctcatggaaaagtcaggcaataaacaagaaaataggtaaattacatagtatgttagataatgataacagctgagcacaaataaatgtgaagcaggatgggcaatataaaatgttggagggtggggatgttgcagttttggcaaaatccaggtaaggccccactgggcaggtgtcataaagtcaaggcttgattgaagtgaggggtctagctatgaggctgtctgggagaatactattccagatagaggaaacagcaagtgcaaaggccctgagataggtatgggccactgtgtttaaggcgtggaagggccagagtggctggagtgaactaagaggaaagcagaagaagagaagatgaggtcagataggtgatggagccctgctcgcagaaagtcctgttggttgctgtaaggactttggctttggtcataagtaaggtgggaaggaagcattgggaaagtttgagaagaggagtgacctgctctggtttatcatttaagggatccccttcacatcccaaatcctcccacattagccccttctcccatcatttagctttttacctgtgctataacttggttctatcccttactagtatctcatttctgggaggagaggactctgtccaacttgttagtgttttattccctccatctagcccaatgtccaggaaccatagggtatcaataagtatgattgcattgaaataatgagtaaatgaaagccagctcccgtgctaatctttaactttttaattactacaacttctttatattggttgtagtaaacccaaaatacaaatgaggaaatgaagtaagaacagaaagtgacagagagagaaaatgggaagagaagaaataaaattcttggagccatcatggcagccttctttaagctaagaaacccaggttctcattccgacattggcgtctctagtggggaattttagggctgtctgtgggaccacaagatgatcatacacttctctgaaaataaatgttcatagtgaatgcttttttgatttttggcagaggatgggaggcacttccattttggcccattatgagaataacaagacaaaatagccatatcatagtatatttattacaaaaattcatgtcctacctggctgtatgtgtgcatacatgtgtgcatgtgtgtctgcaaaggcttcatactagtccacatgtatttatcagtgtggactctatgctgaactaatgctagggatggagatgtcctgccctcaatggactcaacaggggctacacaaatcaagagcggtatagtgagtaatatggtgaggaaataaatacctcttctaagaagcaaatagacttgaatatattagatagaaaaatatactaatgcctgcactgaatatgtgattagctttttttgtttttttttttttttgactgtctcactctgtaacccaggctcaagtgcagtggcatgatgtcggctcagtgcaacctctgcctctaagggtcaagtgatcctcctgcctcagcctcctgggtagctgggagtacaggcacacccagctaattcttgtattttattttttgtggagacggcgtttcaccatgttgcccaggctggtctcaaactcctgtgttcaagcaatccatccacctcagcctcccagagtgctgagattacagatgtgagccaccgtggctggccatgttgagcatttcttgaaaaatagcagaaacaattgcttccttaccaaaatggtatttttcatttttggtttaatgggtaagactggagaaggagacacttggccactatttggagtatcacaattggacttgtctcgtgatgtcacaaaatattcaaactggaagaaaagcattaaaaaaaaaaaaaaacctgtgttcagctcttttgtttaaactataaagaaaaatgtggcccaaagagactgggtgttgccaaaaattgcacataggaagaacagagagggaaaaccaggcctctgagcctgggaccagtcacatgatgacattttgttacctaagtcaaaaagagaatgacagtcttctccacaggagtactttgggattagttagtgggtggtctcattacccataagcccctgcctttattggttggttttttctcactccatctagacacgctgttatcagtcctggagcctgagtacactgtgatggcttcatgttgtcagctgcgttttctcatgccctacactgcagactgaaaaaggatgctccacagccagctttaacaccatgcaccaagcctgccacagccatcctctcttctgctccaagctgctgagagacaggaaatggaggttctgagttttgaggcttgcagggtttgtctgcactgcattcagcttgccagtccccaggagagctggcatgctgcttcagatccagaaagaaaaggagagtgccaatcagatatatacacttctgtaaatctccagttagttccagagctgtcatttgcctgtagaaattttaccacgtttacatgactgacccagacagcaagagctagtgatgcccctctgttgtaactacatggccagagggacatgcaacccaattaaataaaattaattttaagcacacatcctgatttggagaagcatttggacaataacatagtgtcagtgtgagtcacttatcctaaacagttttattgttgtgaccctgatttggacatcgctatggttgctgtgcatgataaacttgaaccatgttttgcgcttaagttttaaagaactgtaatttaaaacatgtataacaaaacaatctatgaataaatgagatctttccaaattagatatctcctttggtagcatgatgagtaattctttccagtatcataacattgagggtctctgagagtctccttattaaataataatccttcttcatagagggttttgcatgaattttgggagaaaagctatttacctacttaatcttaaacaaaaggcatcacttccctgctttctgtgtgatcactgctgcatgtgtttgcatgtgtaaactgtggtggctttacatcatcttatactatggatttttttccatatacagcagtatgaatagaaacaatttttgcagaatttcatgaattataactaaggctaaaagcatggatactgttttccatctcatgctgttatgttccttgccttattttgtttatgtaataaacatttattcagtgtatactactggccaaaggttgttgtaggcactgaggatatatcggtaaacaaaacaggagaagatctctgccctcatgaaacttatattttagcagggaggtaggggcaggtgatgcatgcaataagcaattatcataaatatttacataattaaaattacatagaatgcttgaaactaactacagctgtaaatggagaaaaaaaggagagcaaactaaaggggaagtggttaaatctaggattcaataagaaatagaggggtcaggaaagcccttattgagaagaagagattttagcaatgacttaaaagagataaaggaatgaaacaagcagatatgctggggaaagatcctatccggcataggaatcagctaaagtgaggaccgtaaggaggtaatcttcagccagggaagtcccaggagataattgtggataaatcaaatgagcagagggaagataaatgcagctagaaaaggtagctgtttagggtcagagaaagggctatgggcagattatgtagggccttggaggcagctgtaagacatctgggtttaattcgaagtgaattgggaagccagtgcagttgtttgagaaaaggaatggtgtgattcaatttaagtttctaaaagattaagctagtgaatcttttagccagagtaatctgtatggggaggatgacatggcatagcaaggaaagaaacagtagcctactgcaataatctgggagacagctggttgcctcagtcaagatggcagcttgcagtagaagtgataaaaggagtacagactttgtatatattttgaagatagaaccaacagggagaatttaagaatgactccaagggtttctgtctgagcaactggaaggatgtaatcgcttccagctgttatggaaatggaagcaggttttgttggggagaatgaagaatttaagtttgaacgtgtcaagtggaagatatataagtcaggagagagatctgggcaagagatacaacttgagagttgttggtaagtaggaggtatttcaagtcatgaggatagatgcaaactccaaaggagtgagtatagatagaaaagaggatggaggtctgagccttggtccattcccccagtaagaggtaagggatatggacaggaaccagagaaagaggctaagaagatatgaccagtgatggaggaagaaaaccaagagaagatgctatcttggtgaagaaagtactttgatgagggggagagcttcatggtgtcgaggtctgttgaaaggggctgggtgcagtggctcatgcctgtaattccagcaatttggaagaacaagataggagaatctcttgaggccagtagtttgtgaccagcctgggcaacatagtgagacccccatctctatttaaaaaatagccaggcatggtggcacattcctgtcatcccaattactcaggaggctgagataggaggattacgtgagcccagaagtttgaggttgccatgagctagggccactgcactccaggctacaaaataaggccctgtccaaaaacagaaaaaaaaaaataataaaaattaaaaaaaaaagaaagaaggaaagaaattctgttgaaaggtaaaaagctgaggactgagaatgacaaccagatttagcaacatggaggtcatgggtggattgctggcagcaatttgaatgtcatgatggaaatcaaatcctgactggacaaatagggatcttctttctctttttccttccttccttccttccttccttccttccttccttcctccctccctccctcccttcctaccttccttccttcctaccttccttttcctcctttccttcttcttcctcttccccttccttttctccttccttctttcctttttgtgccattgaactaaaaacccatacttggatattgttgacagtatgattttaatgaatccctttgggaatttttttaaactcttggaagattttcacttatttgatctgtccctaacattccaaaactggcatgaattttaattatcctgagatttcacttgggaataaaatggccaagataacagataagcactttagaaaatcattagcttattttaggccattacattatatcttcttacactgaatatgaggaaaaaagtattagtaacttattttatcatgtcttggtaattgaaagtaagtcacatattcttctcaaagtacatccagggtttacattgtctgttatgtatgcatggcttccctaacaagataataaattcttggaagataacaaccagaccttctatttttaataatatcttttgtgcccagccatgtcttgtacatagtcggtatgcaataaatatgtgttggtttcattttctatgctcattctgtctgatcctgccttcttatatacaagcctcattcagtaatgggaggatagtaatagaaaacagagggaacagtgctaatactgctagaacttgtaggctttgaagactttacaattttgttaggaagagaatagagatgtatttgagaaattcagtagcaaaaaaagaaccatatatagcaacaataaaagatgggctcatgattagtgaccaaatgaaatctgtaggtaatatatttttaaagggtcctgtgctggttggagaaacagacactgagaaaattattcttaaaatactctcctgtcctcccctctctcctcatcaataagatgaatatatgtttatagaaaaattagttaacattatattatgaaaaactttgactattcaatgattttaaacataatttccaatggatttagagtattctatcatgtgactgtatcataatctatttactctcctggattgaaggtttcgatagttgtcctttctttttcatgacataccaaactaagatgaacatcatttattgccatgtctttttgcatattcaatagttatttctttatattaaatttctaaatgtgggctggcatggtggctcacgcctataatcccagcactttgggaggccgaggcagatggatcacttgaggtcaggagttcgagaccagtctggccaacatggtgaaaccacatctctactaaaaattcaaaaaaaattagccgggcttggtggtgcacgcctgtaatcccagctactcaggaggctgagacacgagaatcacttaaacccaggaggtggaggtggcagtgacattgcactccagcctcggcaatagagtgagactccatctcaaaaaaacaaaaaatctaatgtagaattataatattaaaagattgacatacctggagaattgtttttaattgtggtgaaaacatacaatgtaacatttagcatcttaaccattttaaatggaagtttagtgatattaactatattcacgttgttatgcaatagatctctagaactttttcatatgtgaaactgaaactctgtctccattgaacaacaacttgccatttcccttccccttagctcctggtaaccacaattctttctggagtgcaatggcataatctcagctcactgcagcctctgcctcctgggctcaagtaattctcctgcctcagcctcgtgagtagctgggactacaggtgtatgccaccactccccgctaatttttgtatttttagtagagacgggattagaacatgttgccaaggctggtctggaactcttaggctcaagcaatcctcctgccttggcttcccaaagtgctgggattagagttttgagccaccacgcccagcccatgattctactttctgtttgtatgagtttgattactttagataccatttatgaggggaattatacaatagttaccttttgtgactggcttatttctcttagcataatgtcttcaaggtttagccatattatagagtgtgataggaattcttcttttttaaggctgaataatatatctctttgtatgtatataccacatattgtttatccatttatcttttgatgaacatttgggttacttccaccccttggttcttgtgaataatgctgtagtgaacatggatgtgcagatatctcttggagaccctgctatcaattcttttcattatacgcccagaagtggaattgctgggtcatatggtgattccatgtttaatttttttgaggaaatttaatactgtttttgatagtggctaacactattttacattcccaataacaatgtacatcttcactaacacttgttactttccgttttttgataatagccatcctaatgaatgtgatatgcatacacggctttaaaaaaacttgtttcttcagaatatttgcatatggagattagcatatattatttacctttaatattatatattttgtccttgcttatttgatagataaaaaataatttgtatttatttgactactagtaaaatttaatatttttaatacttggttactagccagtttatatttttcttttgtgatttgtaagttcataatctatacctcattttgtattgggttttctccacccttcttatttatttataagagctattaatataatacattatccttttatcttttatttatttatttttaagacagagcctcgctctgttgcccaggctggaatgcagtggcacaaacacagctctctatagccttgacctcctggactcaagcaatcctcttgcctcagcctcccaagtagctggtaccacaggcttgtaccaccatttctggcaaattattaaatttttatgtagagatagggactcaccatctcgcccaggctggtctcaaactcctcagctcaagcaatcctcttgccttgacttcctaaagtgctgaggttacaagcatgagccaccatgtctggctgttatttcatgtttttttacaaacattattttcatgtttcagatacatttcaactttgtttattgcaatttttgcttctataatactgatagaatcaaactgaaacttaagactattttatttctcatttacccctactttttttttgtttgttttgttttttgagatggagtctcactctgccgcccaggctggagtgcagtgacgtgatctcggctcactgcaagctctgcctcctgggttcacaccattctcctgcctcagcctcccgagtagctaggactacaggtgcccaccaccacgtccggctaatgtttttatatttttagtagagatggggtttcaccatgttagccaggatggtctcgatctcatgatccacccgcctcagcctcccaaagtgctgggattacaggcatgagccactgtgcctggcttttacctctacttttatatgaagaaaatccatgctcatgtaatagccaaatacagtcaaattcatttttctctagtgttaatatttcagtcaaattctaatgcattaggaatttgttaatattgcatttaatattatttttccccaatctttttttatttgaaaaatattataatccagtcaaatagcaaataacataacaaaatgagaatttcttaccaaggattaattcatattaacattttatcatattgatttcagatcttgtgtgtgtgtgatgtttactgataaattttgtgtccttgtacagcttttgtggatcagggacaaggggagcatgttgccgaacaaaaatatattaacatgtttgggactaatgcacactgattttcacagaaagtaactgattgattgcaatcaagtatgggagactagagggtggcaagagttttgataaaattcagttcaataaacttgtgaatttaagagcatagagattctattaacgagaatgaatagaagaagatttagacatggtgatttaaaggggatatcaagttagtgttgaagagtaaccatctcaggaaaacagtaggaattagagccagttctgagaatattctgtgtgagatctatggaaataaaaaagctaggaagggaaaagcttaaaggaatgtgtgttgggaagtgcttatagaagagagcaagcaaagtgccttcctgttgtcgtttagacttttccttaatctgcattcctgcagttaggtttactgagctctatggcctgagttattgctcttctatgtagttccagattaagggttaagaattctagtagagcaggagtatttctggaaaagatggttggggggcaagtatagggatggggagaagcggagggcttactctccacctcccaaaattttcatggaaatgacattcagtaaaagtaaatatccatataacaatggtggtggaaaggaaaatgtaggggtagatggcttttgcggatcaggaacaaagggtatcataatgctaaataaaaatatgttaacatgtattggactaaggcacactgatttccagatggtgtttacatctgaggaagaggaaatggggaaaaggtggggaggtagcctctttataagaatcttcaatgttttattaattaatatttctaaaagataactctttttgaaaagagaaaagataaaaatattatcatccattaaatgtgggtagtgattaacttattatctcaggttaggttcctttctagttgagatttttataattaaatttttagataagagtcagaaaatttaggataataaccttggatgacaaaggaagaaagttttaggatattttaaatattagtgaaattccaaataaatttaagctgagagctcactggttaccatatatgtttctctttaacacaagaaattggaaatgcgttaggtcaattcaacaagtaacatttggaaataggccgggtgctgtggctcacgcctataatcccagcactttgggaggccgaggcgggcagatcacgaggccaggagttcgagaccagcctggccaacatggtgaaaccccatttctactaaaaatacaaaaattagctgggcgtggtggtgggcgcctgtaataccagctactcaggaggctgaggcaggacaattgcttgaactttggaggcagaggttgcagtgagcagagattgcaccactgcacttcagcctgggcgacagagcgcaactctatctcaaaaaaataaataaataaaattaaaaaaaattggaaataacatatttgctattaatatcttaaaggaggtatttgtgttgaattctttgtcttagtcattatccttgcttttaaaaaaaatgttagaattcctttttctcaaaattctgaatgtgctgtgtttaacagcgtagttacagttctgaaagggtagtagatttctccccttgtctatttgtttgcagcaggtcatgaactcagaccttttctcttcagtgctttgcttctgaactacttattctgataccctcctcacctgaggaaacagagcctaagaaggttctccttatatggattcaggtagatgagtttccataaaaaaaaaaaaatgacatcaagcattgatctgcctgaataaagcaattctaccagttatatggcatttggtgcttcctgtgaattgatacaaacttcattaaagaaaatgacagatggcatatggctgcaggcaaaatgccagtccacatgatgaatcctaccatactctagtccagtataaacaatgtttttaatcaccttcaaaaaactgttgcattaatttgtctacagtaaccaggtaattataaatgtgtagctagttccttattatcttaaaaaaataaaaataaaagttagcaactaataggcatttagcttgagtttatattatagatggccaaaggagattttatggcccaaaatggacatggtgaggtctgcatgtgaacgatgttacagtagactaaccacagagcctggagttcctgcacttttcttgatttgtttggaatattactttgagaattggaaggcctggggtacgaaaaatgattataagatttttctttgtttgacaagataagcaggtctgtgtgaggcagatactttctatggactgactgcagacaggtttcagtcacagactcaggttttatggcattctctttgaaggtgggtgtctaatgtaactgaattttagggggataattacagtcttatcaaattctgagatgaacttcatcacttatttaaaaaaaatttcctgtcaattagttcttataataatatacttttctggtcaattttacatgcagaatttggtgaaataaagaaacataaatagataaaaaataaatattttaatgatgcccaaataaaatttagatgtgtaaggactaaaaatgatttttaaaatagttgtataatagaactacatcttagtttcagcacatggaatttatatagttcattttagttagtgcttcatttcaggctgctttttttcaaacaacagaaattgactttggctcatttaaatggaagaatgttttagaaagttattcactgatggggcagaaaggcagaagaaccaagcatgaatcaggttccataaagtttcaagctgctgtaacagaataccatagactaggtggcatataaaaaacaaatttatttcccaccattctggaggctgggaagtccaagaacaaggtgctgacatatttagtgtcagtgagggtgctcttcttcatagatggccgtcttctcattgtaccctcacatgcccaaagtggccaacacctctcttaagcttctttttaaaggcactaatccctttcatgagaagtctgccctcatgaaccaatcatctcccagagaccatacctcttaatagcatcatcttgggaggtaggatttcaacatatgaattttgaggggaaacaaacattcaactcatagcagataacaaggcagtaaaacaattagccaacactttataaaaatcttcaatgttttattaattaatatttttaaaagataactctttttgaaaagagaaaagataaaaatattatcatccattaaatgtgggtagtgattaacttattacctcaggttaggttcctttctagttgagatttttataattaaacaaatttctagataagagtcagaaaatttaggataataaccttggatgacaaaggaagaaagttttaggatattttaaatattagtgaaattccaaataaatttaagcttagagctcactggttaccatatatgtttctctttaacacaagaaattggaaaaaatgagttaggtcaattcaactaataacatttggaaataggccaggtgccgtggctcacgcgtataatcccagcactttgggaggccgaggcgggcagatcacgaggccaggagttcgagaccagcctggccaacatggtgaaaccccgtctctacaaaaattacaaaattatgaaaattaaaaaatttcaaaaaaatacaaaaattagctgggctatagtctgggtagggcatttggtactggtcccaactccactgggcactcttgcctgtgctggaattatcctactgccacagataatgtctcaactgtcctcacatctttgtaccattctccagagattcaacgttctaagcagaaacctttagctggctgagtttaggtgatgtaccagttctctaactgcctaatccattggcttctgaatgagaggtgaggccctccctcccaacaaataggaagtagtatcattgttggacaaccaaaggcaacgaccagatgggaactaataaagctgtatgacactaaaaattcttcattaaatcatgcctttttttctagtatttttctctttgtttttgatagccaaaaacatatgtagcaaataatgccattgtcaacatgactaactccaacacttagttatagttgttacttttcagcccatggtgttttctgctgtgacaaaggcagagttgttgttcctgaactgcacatctgcctccttttcttgtacacacttctgatattttcaagtttaggagaaagcaggcatttgccttacgtctcaactcatattttaaaatcagtgtcactttcctctgcttattttgctatgcttttttagtgaataaatatttaccgaagacttctgcattagtttgcccgggttgccataacaaagcaccacacactgagtggattaaacatcagaaatatagcgtctcacagttctgaagggtagaggcctgagatcaaggtgctgggtttgcttttttctgtgggccgtaaggaagaatttgttccatagctatcccctaccttttggtgggtttctggcaactttggcattgcttggtttgtagaagcatcactctgatcactgctttcatcctcacatgggggtctctttgtatgtgcctctgtgtccaaaatctgccttttttagaatggcatcagtcatattggactagggtttgccctaatgacctctgttaacttgattacttctgtaaagatcatatctccaaacaaggtcacattctgaagtaccggtgttggagtttcaacatatcttttttagggggaacacgattcaacccatagcagcttcttaaaaggcaacctctttaatgtgaagaatttgaaatattgactcatttctggaagaaacaaaaacaataacaacaacaaaccaaactttaagagtaaggaatatctaactgggcagtgttggttgtcaaatgagtattatacacataactaaatttcagggctcaaattgacatgatttctttgaggaaacttaaggaattactaaataacttttatcagtttgaagaggttctcttctattcctaaaaatattcctggttgaatattttcattatgaaaggctgctgtattttgtcaaatactttttctgcatctattgagatgagcatatggtttatatctttgattcttttaataatatatattacatgattacttttcatatgttgaaccaactttgaatttctggaatagctcccacttggtcatgattataattctttttaaaagctgctgggtttggtttactaggaaattggtggaagatcttttcacctatattcataggggatattagcctgtaattttcttttcttctgaaatttttgtctagttttagtatccgaataatactggcttcatagaatgagctcggaagtgtttcttcgtactctttattagaagaatgtgaggattagttgcaattcttcaaagtatttaatagtagaattcaccagtagaaaccatttaggtctgggcttttctttgcaggaaatatttttattacaagtcaatctctttgcttgttacagttttatttagactttctgtttcttcttgagtgagttcagtagtttgcgtctttctgagattttttttaaatttcttcttgcttatctaatttattggtctacaattagttatagtattcttgtaaaatcttttttgtttctgcgaggtcagtagtaatgtcccctctttaattatgattttagtaattgagccctttttttttctttgccagtcagctaaaggtttgtcaattttgttggtcctttcaaataacccatgtttggtttcattggttttctcttttgttattctattctctatttcatttgtttctgcttaagtttttattatttctcttattttgcttgctttgcatttatgttgctctttttctggtttctttcagattttctttgtggatgtgctctgaaatactagaaaattgaaaccaattctatttcccttcagcaaagcattaattattgtgaaatactaatgtaaagtcaatgtaatagcaactatttatttaaatgagtagatatactgcaagaaaacattttactgcatatatgaacataaccaaagggcatctttaaagacagaaactttaaatgccaaatgcatttttcatattttgagtttcatttcaagacatctgatggaagatagtattattctataataaaatattttaacttttacttatagtagatgcagtaaacactattgcagctttaaaaatacttattatagtacttagcattagacaaattgtttgaagttttaaaaaaatctttacaaattaaaagctatagagtgcctataatcctttaattcaaaacagttgttttcattttccaataaattggtaaaagggaacttaatgacattgtctttccactaaacatcctagctgttttcaagaaaacagaattaacaagaaacttaaaaaataatattgtaaagcagacagtattctaagtcattacagttaatacaacaacaaaaattcagtgtgaaactcttgaaacgaactttaggatatattcggttaaattatggtctactatttgtaatttcatgaatttttttccaagtattggaaatgatctaaatggctgtgtttgtgtcacaataatgttcaggttacaatatgctgtatatttaaaattacctttgcattttaaaaataactatttaaaacactgccaaaatcggcatcataattattttggaagacttaaaataaatacaccaaaaacaaaaccagaatttgcatctaattgcctggaatagtttctctagcctcatttgccagacagaggaatgagtatcttgaaaatctaaggttctttagggctataggattgtatgcctatcagcttggattgctttttgctttatttgactgtggccaaaggtggaaaaggccttcttagatattcttactaggaaatgtaatcttgaagtctatgtcaaagctttcacacaaaattggtataaaatttatacagtggaacttactctaagcagtcaataatagctatatttctgaaaagatgattttaaagccaactgcaataaatggaataactaacatttacatgtgctaaatcttctaatttattggaaatattgaagggccattaaatttaaaaatgcttttgtaaatgcaaaacattaacctctaatttaatccttgtaggaatacaattttttttaaatcaaattttcctgaagcagccatagctgaattagttgttttacttttcaaaattcgcggtgaagggttacatttaaagcagagaggagccccctttttcctcttcatttattctaagtagtacctgaaagcaaaagttggcaggccgcaggcagagaataggtcagccacattgttccttgccttgctgatgcaaaagagagaacatttcaaagtaaaacaaggattggcatcagagaaattgagttctgtgctcttttaaaataatcttcctgaggcattctttcagaaaactagcatttaccctccccataccacacgagtgaaaaagtgacctttttcagagagctcaaagtcaaattagttctgtaagtcagtctagggggaagtgagagccaatttgtggtcagggttgccaaagagccaatgtccaagaaaagaagagaggcagggtggtcaggacgtgctgagaaagactgaaaaaaatagggaccttgcagctgttgaggccatagtagtgactctagggaacatgtagtctaaaaagcctatctaaaagcaaagttcagccttgagagcaagagctgggaaggactcaaggaatgccatgaactccacatgagggaaacagatcacaatacataaatgtaagttcaaaggcagaagaagagaaagagttatgagaggtaaatggagagggtaccatgtaggaagtcacagagaagcagtaatacaaggaaagattataggtcacttttttgctcttctgtcagcaaaacccatgtagtaaaagaagtacgtcagggagaggacatctaaaggtttcttttttttctttccctttttttttttttttttttgagacatagtttcgctcttgttgcccaggctggagtgcaatggtgtgatctcggctcactgcaacctgtgtctcccggattcaagcgattcgcctgcctcagcctcccgagtagctgggattacaggtgcctgccaccatgcccagctaaatttgtattcttagtagagacggggtttcaccatattggccaagctggtctcaaacttctgatcacagatgatccatccgcctcggcctcccaaagtgctgggattataggcgtgagccactgcacccggcccaggtttcttacatgacttatttgaagaagacaggaacagacaacagatgatcatatcaaagaccaaaaacaacctaacatgacagttaaccttggctgcagaattcttattaattcctaatgagagtagactgatgataacacaattatgcctgaaattaatttgaatacataatttaatgtatttatagtttatcagcactataattttgttagttttaaatttttatttaaaaattatttagatatatcaggagtaaaaattgctgaacctgggagcacttagaattttgacaggttgcagtattcattaggatactgttagatgctgtgacaaataatccccacatttcagcagcttaatacagtaaaggcttcttaacagactagcgtaggtaactgttcccggccagtaagagtgggcagatctgctgcatgtggtcatttaggaatacaggctgatggaggctttcccactatcagtgtatgacttctgttattattctgggcactgatgttcatctcactgaaggggttaaagaatgaagaagcgtgcatgaaaggtttttttatttttcttcacattctctcgctgagaatgtaaccacagggctacagtaaactgcagggcagactagaaagtatagtccaactgagtgcccagaaagaagggaaatagagattttagtgaacactaagaagtttctgcctggtacacataatcactggactcatgggagggactgtgataccatgtctacatctaccaaagactttaaacatactgggatcttagtaggctcctgaatgggttacaaagttggttcttggatatagttagtatgaatttgtagaactagcaacagtggaatgctgttggatagtcaaattttcctaaggcatagatttattctaaattttacttgtattctaatctctggggtttatgtgactcattcacataaaaatagaaaaatcagtgtatatctgataattggcagtattcactgattttatccatataaaatatcttttatgatagaactaaagatgtgacatgtctttgacaaatcactgtgcctaattagaatattatgtttcaaatataacttaaaaatatataggtgggtacatatatgcattatgcatatatgtacattagtgtgtatacatgtctgtgtaccaatgtatataactaaaaaaatttctgtgcaggagttgaactacaacagtggagataaactcataatttgtttgctatatcatggactttggaatcatctgttttcagattttagtaatgctatttaataccgcataacccttaagcaaattactcaacctcattaagcctcagttatttcatgtatacaatatgaataacaatagctgtttatcaaactggattattataagtaataaaatgagattatgtatgtaacacacttcttacagaatctggcacatagtaaatgctcaatggcatatattatgcatattatatgtatagtaggaagcttgacgtggcctccagggcccctgtaacacacaaaccgatggtgcagatagacatgaaaatagataggaaatagctggctgctgagatttaatagcttcatttattcgttcctttgttcctagcagtaaatactgctcggcccttaatatgtacaagctctgagtgatggtgggcacaaaaattactaaagcagctttattgttgttaaagagtttgccacctgattatgagaactctagcagtcatgatacaaggtgacatttacacaagagaaataccacagagtgatatatggcttggaaataaggaaaaatatttcttggaagggagagatttgaagaaaatgttttggacatttagaattctgagtcttaaactggctcttaaatccagaatttcaagaaatggatagaggaaagagagacattcaattcagaaagaatagcatgagctgggaatcagggaaaagcacagaatatttttaggcaaactgaaaaataagcaaagggattactatgaagtcaaactgcaaagtcaagccattgatgtcatactaaagagttggacttcattctgtaaacaaggagaaggaaaggcaaggtgagaaataagagtgaggaaggcaagttctgagcagcagaatgacatctatgcccttgaacattttacttggcctttttctccattcattttcctcccctacacagcaaatggatggaactaagatcccttcctgccctcacagtctgggagaccactacatcctccagagtcactgtcattctccgtctgctggaacatcccgattctcattggtgtaacctctccaatgctatttacctaggctctacccagtactgttgtcatatcctttagactctacatttttcttctctgtgggcctgcttttcatcctctgcaataggaacatgagctgtatctcattcattcatagagaggtgtcttccaagcccagatctccagctcctgaaccactccatcagctatggtgagattctttcctggacctcttccagccttcacctcaattagctgggcatgggcagctaattcattcttgcactttctccatattattgcttctctcctaggttttttattgtggttttgtttttgttttttgttctttgacttggtacttccactgttctggaagaatgcaagcagaaatatcaaagaggaacaaataagaaagaattactggggaaaagtgatgcctttataagagtaaaacgttattcttcactataaagtataataagagggaaattttcttcttttacttgttagaattataaagatagttatatatgtacttttttcaaaaatcaagctgtgcgtgttagctcatgcctataatcctagcactttgggaggccaaggagggtgtgtcacttgaggtcaggggttcaagaccagcctggccaatatggcaaaaccccgtctctactaaaaatacaaaaattagctgggcgtagtggcgcatgcctgtaatcccagctactggggaggctgaggcaggagaatcgcttgaacccgggaggcagaggttgcaatgagctgagatcgtgccactgcactccagcctgggcaacagagtgagactcagtcaccaaaagaaaagaaaagaaaaaaaaatcagcactagcaatgacctggtttttacgtagcacttcctaatagcttgcttctctttttgtgaataggatttagcacagatatcagccagtatactaagacaattaaattttttttcagagtaaataaatatcgaatataccaaaatatcattcagtaatgcgattctgaaactaacgtcacaaattaggttcaataaaagaacaggatctttttgtctccaagtataacatgttatttctttcgtaagtcttctcaggacttaaaactgcttctttgaagtattctttaaagctttcagcctctcttgtcttgtcatggctacagtatttgttaattaatttaacaaacatttttggggtgctgaggtaaagaaatagattaacatccagactttaccattgaaaagtccacagaagaaggctaacatgtaaatacagaattgtatggaatgcagtagtgaagtaggaggtgagactcagctctggaggtggaacttggacactggaccaaattgcggactagctaaaacaggaccagagtggaagagttttccataagacacacctaccagtgtgccatgtcagcttaccattgctatggcaacacctggaagttaccactcttttgcatggcaataacctgacaacccagaagttaccacccttttcctagaaatttctgcataatctgccccttaatttgcatacaattgaaagtaggtatgaatgagtgcaggactgcctctgggctgctactcagagcacactgactatgggatggccctgctctgcaaggagcagtgcctctgctgctgctgtacattgctgcttcaataaaagttgcagtctaacatcaccagcttgcccttgaattctttcctggatgaagccaagaacgctcctgaactaagccccaatttgggggcttgcctgcactgtgtcagtaagtgatagaatagagctcagtatgtggtccaggagggagtgatcagtctgtctgtgatgtcccggggggaatcaatgagaaggcaattcacaaaattcacaaaagaggctttgaaaagtaaattagaatttgctgggtcaaaaatggagaaagtatggcccaggcataaggaatagaaagcgcaaagacaaagaaggaagttaggatattgtgcagaattaagtatggcttgtaaatgggtgtgaagtgatgggtagtgagagaagaaatgggagaattggcggggactagatgataaagggcttttcatgtccaacgaaagagtttagatattgactattgattcccatttgtttattgttcatctgtttttggttttgccttgtattcattattttggggacacttccccttttaggcatttgttgaaagaaagctcaagaccttctcccaagagaaagatgcacacataattacttttgcatacaaacacatccatgaacttggaacccaagtttcaaaccactgcaaaaagtcactatgagtcattgacaattattgagcagggaaaccacatattcaaaagtgtattgtcagccaggcacggtggctcacgcctgtaatcccagcactttgggaggccgagacaggcggatcacccgatgtcaggaattcgagaccagtctggccaacacggtgaaatcttttctctactaacaatacaaaaattagctgggcgtggtgggtgcctccaatcccagctactcaggaggttgaggcaggagaatcacttgatcccaggaggcagcggttgcagtgagctgagatcgtgccactgcactccagcctgggtgaccgagcaagactctatctcaaaaaaaataaataaataaaaagtgtattgtcggccacgcatggtggctcatgcttataatcccagcactttgggaggccgaggtgggcagatcacctgaggccaggagtttgagaccagcctggccaacgtgacaattccctgtctctattaaaaatacaaaaattagccggacttgttgtcaaacacctgtagtcccagctactcgggaggctgaggcatgagaattgctgaatcacttgaacctgggaggcggaggttgcagtgagctgagaccatgccactgcactctagcctgggtgacagagcagactctgtctgccagaaaaaaaaaaaagtgtatcttcagagtgaacccctggaggaatgtggagaatctattagaaggcatgggactcatgttagggaaaataggaatttattgcaatatttcagccaagaaatgaaggtctacgataaggtggcagcaaatacttgtttttaatttggctcctgctttgtgttgtctatctgcttattgaggagacagtactacaagagttaaatgtgtaaatggtgttattactgaagtagtgatttcagatataagtgcagcttcatgaggaaggatgaagcattcagaaggcatgatgggtttgaagtgtctatgggttagaccactgcaggtatggattagcaggtcaaaagagatgtcaaaaatgattttaaaaatattctgtttcaccatatagagatgggagatttaatagtgtgaggggatgagatcttagtggtgaaagagcgtaaattaagaagagttagaggcatcagactggaagattggtggagcttgttccctaaatcaggaatttaagccttaactctcttgttaactactgctctgtgttggtaccaggtttgtgaatgatcaagccactggcagaagattactttctaagagtgagagccttcccagggcttcgaatctggttaagtgaaagaatggagaagacggtaaattttaagaaaccatctgatggatgttattaggtcacaaagttgacattcatcaagctaataggcctatcgtttattgcaaactacctgaggtcgggtaaattattacctggattaaaaacctgatgctgacactggttaacacttgttacttacctttctgaacctaaatttctccatctgtaaaataaagtatacacacctactcaagagccaagcagagggaacgagataacctatataagccacctgtatagctgctgtgcaaagaagctgttgaataaggagttggggctggaaactctgacctacctctttaagttttgtaataaaccttccagttctaactagtcaatgaatgacccattttgattctcagacctgccactgcttctacctatctgaaaaaaacaaaacaaaacaggaatttgaaaatctgttatagaagtacattttatgtttagctatttttttttccttcctctatgatctgtaggtatggggtgaaatgattatattgtggtcactttagaacgttcactctctttgggaattaagtaattacaatttcttgaactaactgccttatcctacagcctagtacagtgacagctccaatgtagattcttgggcatgcgttgttttcttgagaacctttggaattctagccatatcttgctaatgatactcacttagcctcatcaaagtctcactgatctcttttctgtacttgagatattaaatgaaactctcttttgagaatgtttgaactggaaggggagacttcagaattcatttagtctacttcattttataggccacaaactgttcattttaagtttggtgtgctcaagacctgatcatattttcctctctattcttatatcagagttaaaagaatgttggctatgcacttcgcgcttacacattaatatagagcccagactgtagggagaattggagacttgaagtggggaaagaagattggggagcagaattacagtgtgttatatagtactgcagcccctcaagggagctgtaattaatgtgtgcaaggaaaacactgcaaggaaactaatttaaagaacatactgaaacaattttctcccagcttttcaaaacaaataaagaaaaaaagaagtcaccatcaagttttgaggaagcatgaagaattccagcagaaaggaaatttgttgagagcccgagaaggggctgctggttagaatgtaaagcctcttttaaacttaggcttcctccaccatttgtcagagctctgtggtccctgatccattcattaagcatttcacatgtatgtcactctcattatgggtcagagtttggttacaacccattgactgctctttctttgcatcttggagactcagttctttataccagttgatatcccgctagcctttcctttctgctttcctgcttatccttttttatcctaagcttgttaggtaacttcagagtttagaatgccttgtgatggtatgtcacttgatattgatgctgttaattccctagagcgaagtcttctcaactttttgtctacaacccataataagaatttcattttcaatccaacccagtacacacatacgtatgttattgaaaattaaagtttcatgaaaaaatactatgtgtgatatgctttgatacttttgcttctcttcaactctatctcatttatttaggaacaaaaaagcatcaaaactcattgaagagggccatttgattctcagttctaatcactatgagtatgcttcacacattgaggtcttcagatcatctgcaacaagtcacttgaaggtgtctggtcccaaaccctcccccagacctattgaatgagagtccgtattggcaacttctaggaatacatagtttaaccagttccttggtgtggttttaaaggttaaaaactagccccagatgttaacatcttaacattatctactcacaaaaagctatctcctttgctagttgatttttttttcttttgtatagctatcaatggctagagcaagggctctgatcactttttttcccccttctagagatagggtcttgctctgttgcccaggctagagtgcggtggcatgatcttggctcactgcagcctcggcctcttgagctcaggtgatcctcctgcctcagcctcccatgtagctggaactagagtgcatgccactatgttgaggtaacttttaaactttttttttaaagacaaggtctcactatgatgcccaggctggtctcttggctgcaagtgatccttctacctcagcttcccaaaatgctgggattgcagatgtgagccaccagacctggccagggttctgatctctgaattcccccttcttcttgctgatagagatcagctcaaaaggtactggaaaccttgaacatctagtaataccttactatatgccagatgctattctaagtgtactatatgaattaaacctcacaacaaacaatgttttgtatgtggtactattaacccattttacagatggggaaactgaggcatgacgaagtctaatttttctgaaattacattgcaagcaaatgacagcactgggattcagatctaggcattctgactctagagcccataatcttgaccaacaccctgtctaattcttcacttagcatgaaacgggagatagtgattagcccaatttgtcactgagagtcttaggtgatttcactaacctacagcgtgctacaggaagataaattagggggtcacttggtcccatctctactgcgtacccatcctcaactctagggatctgatgattactcttcctgcacttgtctgtctgtcttaagaaggagggagagtagcagctttctgccgttatctctagctttgactcattgtcacctgtgaggctaacatcactcaagcctataataaaattcaaatacttcaaatacagcaaacttaatacttagtgattattatatcatataacaaatgctcttatggatcattaaattcattatatctaaatattcaaatgattctgaccatacaaatgattctgacaagacaaagggataatttatttaaagtatatatttagagcaaaatggccttcagaagtcattactaaggaaactttgtcaagtttcctgttggggcatgccagctagtcttcaagggaattttctagtatttctcctaacacgtgccacagtaagagaccaataaagaagagttgaattctgaagaatgacttcagacagtaatcattggaggtgaattgcgactgttgaacaggcagagaaataaggaacagatatctggtcagagggttcaacatatgtgaagactaaggcatgaaggattatgtcgtcttcaagagctggaactgagagaagggaaaaaaaatcacacaatgagacaaggaaagactgagttgagttgagaagtttcttacaagcttacaaacttgggtctactcttctctgcactcagctgtgtatgaaagagacctgtcaggatctcactgtgggggctcatctatgccccaagtttaagatgcttgccccagatatactccagagttttagatggctttgggcttgcagttggctcatacacataaagtatccagaagtacttgccaggatgagtacacaaattctgtctctcttctatagccctgttcagttaggaataaagatgaaaatgagggttgtgatagctgtgtgtgtgtgcacatgcgtgtatgtgtgtatggctgtgtgagtgtgttagtgtatgcatccttgtgtgcatgcacttaaatatacttatatgtacatgatagaaagatccatgtttcagacaggagactaagatagaaaattaagtagaaattttataattttgtttctattatttacctgccatgtgtttgtctcagtgtttgaactgagaaataggcttttagttactatggatatgataatgttaaaacaaacatcatttatggattgtactttatatctcaaagttttccgatatccttatttatgtattattttaattttttcttaacctatgaaaaaagctgggtgccatggttcacacctgtaatcccaacacattggaaagccaaggcaggaggacttattgaggccaggagttcaagaccagcctgggcaacatagcaagactccgtctcaacaaaaaattaaaaaattagccaggtgtggtgacacatgcctgtagtcccagcaactcatgaggctgaggcaagaggatcatttgaccccaggagtttgaggctgtagtgtgctatgatcacatcactgcattcttgcctggatgacagagtgagaccctgtatcaaaacattttttaattaaaaaaattccaaattccatataagactatccctcagtgtgccttcccagctgccctaccccgaccctatgtcagactgtgatttgtagtatgtttcttcatatttattttgagtattaataatgtaatcttatcatattcaccctgataggacactgtagagtttgtttaatgaaccatcttgggggaagaattaaccaacaaccaagatttgaatacagcttggtcctgggcctccttgggccatagcgcaaggcagctaagtggtgctggaataatttctctttgtttggctgcagataccgcatactctaagcaatttgcagccttccttatataagaactgtttctgaaaggaaattccccaagtccagctcttctggttatttccgtttcagctctgaagcgcttactctttgtagctgaaatatggagaactattgtattttttggttccctaactcagaggaaacatgtgaggaatttgctgtaataactgatctgagttggagtgtttgattcctgacacagagtggaggacagcattgtgaggggacatttcattcaagattgttctgttaagcgggagggaggtgagctgctcacagtctatgtcaatgagaatttccctcaggatatttagtgtgtggtggtaatgcatatttaagcttacgtacaacaatgtttgcaaaatcccaaacttggaatagaactctagatcatagtggccaaagaaactgactttgcttgtaagcaagttggatcaagatctatatgagagctttggggctaagggaaataaagcattgtcccaagaaggaagactttgccttgacaaaacattctcttacaatgtgattctcctaagaaaccataaaagagcagttagggatccatccatgcattttaatatttgaagagtttcagactgactgcatgtttgacagctataggaattttatttttataagaatttatctataaaaataaaagtatatctactatctctaaatctatatatctgagttttaaaaatatagcttctctttagcttttgctagcatatgctgtcaaactccttcatgctgccagactcatccaaaaattaattcttctaatgcatgccatatttcatgttgttttggctgcttttgtacattctgaagaaaacagggaagataatggtttccttttccaatttaacatatacatgcgacagagaaatgtaaggatgttgcactcccagaggatcaaacctaaaatgacaatagattcgactgatttttttaaaaaagaatcctactttatgtaatctggacaataaggcacacatggttggattaaaaatattgtgtttttaagatctctttctaattcttactttataaccataaagaaatgaggctatgtgttgttgcaagaagtcttattgcaaacacatgcatgtgcatgtttgtgtgtgatttgtaaatttagctctagaaaggtgtaacaataaaatggaattgaatttagccatggctcttacgagcgtgagtaaagtatgcatgtggaaacctaagatgttaatgaaatcagcatagactttaatggcattctggtgtcttcaaaagatcgccaccaaataaagcttaatgtgtcaaaatggaaaccccaagtaagagaaatgtgggaagaagttcaaggaacagaaactgtttggggaagatgatttgaatgtcttccaaaaccttcgagaagcattaagctcaagctcagccctttatctttgacaaataccacactgtgtatctgcttgttatttcgtggtcctgttgctcctgtcagcttgttaaatggaactctggtttcagtcagatgaaaatgtggtaatctctgtgctttgcttgcctcggcgtccgaggagcggctgtgcccgactgtgtgaggccgcccagtgccaagggtaactactggcacctgcactgacagcaagcagtctgcagcaacagattgaaaatgttcttttcagatctttagattggaacttcagctttacttttaaaagtttcatgtccacagcacggttgacaaaataaattactaaaccaattgctttgggagcttccaagctgtgacattaaggtagctgcgagtcatcattcttgatgaaggagcagcttcagaaattgtgtgcatctgatggaggtttggcaaagtgtgtaagtctgcagacctatggtaaacaggtctcatttctaagcatttattttcagaaagggaaaaaaagagctgtccattctcaatttcggacttattttaaattactcacagggaaatgggtgccccatttaatggcattgtttattctcacagagaaatgtttgcagtgaaaatgcaaaataccatttcttttctctgctgaggctcctcatcctatggtgcccactttactctcccagcagagaatgcagaaaagcaccaaaggcagcatcatgaaacgcagagctgttaattcccaactccgtcagagttctgccctccttcccatttggggagctgaactgagccattagaactttccttttacactccctctagaatacaagtcctgacaaaattaaagggctttatacccctaaagcctcagaaattctacagggtacggtgagggtaggggtggggttgaagggatgggaaattcataggttaaaaacaaaaacttgggcgaaaaatccaggctctgccagttactatcagtgggacctcagctagttacttagacatctggccctctgcttacttgtttgtgaaatagaaatgatcatatctgcctcatgtgcttgttggaaacatataaaacaagataacttcaggagcaaagtgatttatatctgcaatgttgaaatggataaaaaataaaatagatatgtgagtgcatagatgataaatatgtcataaaacaaaggcagcaaagtgttagcaattgtaaggagagatgtgggtgtatgcatgtttgttatataattctctcaacttttctgtgcatttgaaagcatcttaatcaggaggaagcgatttagaagggcaaatcttttccatgtaagtataattcccgtattccctgcctctagttaaattccagatgtaggcacacggccatactgaacctcagcggagaatggaaaaaaatatatctttttcatggaccactgtcagcccagcaaaaatttagaaattttatttccaaggaagagagataatgggggaaaaataggcaccttgattggtcatgcaaacttaactctctgtggcacatactacatgccaaataacaaatggtgccattcctattaaggaagggaagtaatgcctgccccttttcttcctcggggtggagtgtcctgccaagtctcctgtcctttcctgggtgacccagggggcttattgcttccatccctgctcagatggttttgcatttccgtggcagcattttactccaccctccattgtgcatcctagattctctccagaacccctcccagcggaggcctgaggttagcttttgtgtgacatcgggtctctattcttccatgtatttaagctcaaaatgtttccttatggggaattttcttaaaagtcttcaatattgttaactctttgaaaccactgctgtgtgaaggcagctgattgttccattgtgggtcccataggaagaagttctatggttcctccttattgccttcttggtgggcatcccctatgaagcaatgcagggaggactccatgatagtgcaggcacttggcctttgatttccatccagggaactccctccacctgtctatgagagaactgtgttgtggaagctcaccgggaagcctatggaagaccaacacatagaatgggcagaggaagacaaacctccaaaacacaccgactacaacaaatacaggacaacaaacagcaataacattgagaataggaagctcatcatggaggagaaccaggacagacatccacgaaacccaaaagaagaaaaaaattcaagaaagactggtcaattgcatctaaagctactcagtgactaaaaaagataagggctggttgttgtcctttagttggtgatttaatgaagagccattccagggaagcagtgggggcgaaagtcaaatttcactaggatgaagatgacagacaggtaaaggagggaagagagtaactgtgtaggaattcagcagcaaaaaggagaggtttgtggtcacaagggtaatgcggtatacggaaggattttgttttgtttttgtttttgagacaggctctcgctctgttgcccaggctggagtgcaatggtgcaatcttggctcactttagcctcgaccaccccaggttcaggtgatcctcccatctcagcctcacgagtaggtggaactacaggcacacaccaccatccccagttaatttttgtattatttttgtagggatgggtttttgctatgttgcccaggctggtctcaaactcctgggttcaagcaatccacctgcctcggcctcccaaagtgctgggattacaggcatgagcaactggactagaaaaggtttttcatgatgagaaagacttgagtgtgatcaaatgctgataagaagggaccagagaagaggcagaagttaatgatccagaagagataggaagtagctgctagagagaggttgcttagaaagaaggtaaggtaccatccaggcaaccggaggagggattggccttggctagaaggattcctctcacattggataggagagtaggcatatgccatggtttgcatgtaggtcagctggcacagggtagaattgttactgctttatttagtaaatgtattcctctaaagtcatctgcaatcatatcacattagccctttttgtgacactgtgttttttttgtttttttttttttttctggagtttattagcaaatgagatttcattaccagctcctgctaaacaatgtctcctctatcccacacttacgcatttctgaaaccaaattcaagtcctaacatttattttcactgaaggtcatactattagatttagatcatgtttccaatttgtcaaaatctttttatattttaattgaactcacaacatatcactgatgtgtttcagtcttgtgttacccatacattaaacaatcagctgtatgtatgtcttcatttaaagaactgtctttagctctattttacttttatttcatcaactactctctcccccaaccccctgagactcaagggaagaagaattaaactgaatgctttgatgataactgataaagccttttgtcctaaggagtcctcccaaattggattaagaggattcatttgtgttttgcggtgtttatatttgaggaagacaaggatgtgaaaactctcactctctctgtgttcattctcacaaatagatggataccgtcacttttcaaggcttgtccatctggaatgcatcacaaacacattgctgggaaagtaaaagttccagaaagagcttcgttttctcctggaactgtgaaattgagtggcctagttctctcctccatgttgttgtaaattcacaggagtgtaatataagctacatttttaaccatttgggatagcttatgattgaataatgcttcctgccagacatgttttccctttatttatcacttacttttctctctaatttcagcaacagcaattgctgattatgaaaatgactctaattgttcaacctttcataaccacatttaactaccaaaaacaatctatctgctactttgaaaagcagttaaacaagcaagcaatttattcctgccttcttgcaagcaaccaggaacagggccgtgttctctttgttccttgtactgctttggaaccatgagtgcctctttctaacttgaatcaaaatctgcttgttcctaactgctgcctttgcaatcagtaatttgactcagtgggcttaattcaaagcaggcactcacattctttagactctttgtcagtcttccaggaaatcaagttgaacaacaaaaacaaacaaacaccggccctaaattaaaccagatagggaggaagaaacgtcaatgaatgatgaagcaaaataacaagagtcaggagaaataaatagaaaccatttcaaggctccacctgccgtggccccattagcccctcctttacctccctttcctagaggaaatcaaagcaactcctatgagcaatcattctagtcagcttccagacttccagagcctgctgaatctagctcctcccaccctgcccccagcaggtgagcacacctgggatcgctgcaggctgacattgcatcgtgatttctctgcatctcaaacagccggcagccctgcagaaacctcttccccttgctgagataaagtatatgaattaattcccttttgagttaacccgcgcctggttcctctcagtaactactggtactgggatagagaaggagttggcagctctcttagaaaaccagatagttttccttctttgtgatgtgctcaactttcttttgccccaggcttgaaaatacatgccctgtctttaactttccttgtgtgaataaccagggctcaacaaggtaatagttgggtaaaattgttacagaggcattccaaatctaaaacagagatgttccctggtaaatctgatcttatctaatgtttcctaaatgtaaataggccagagggtgttcctttctgaataccctttaaccagatacgttggaaatctattatgtattgtttattttaatttcgttaaaaatgttctcaggtttgaagtgtgatttctttgcgctctcatttaattttttcttctttttagaataaattattgaagacagaactttttcaaggtatttatagatatatctgaggtattcatgatttatataaagtgtacaggtgaagagttaccttctagtatagaccttaagcatgttatcatagctatgtgcaataaaggtgatattaagtttatttaatattgctaccatttcttctaatccttgaattttctctggaataaagctgcagtgtaatgaatgagattaataaaaatagaagggttatgtgtaactggaaagtggggaaatcactttgttcatttatggtagaatatttaattgaggttcctccacacattcacattaggaaagtcacttggtctttaggtttaaaaataataatttaacttcaaacaatccttaactcttcaaaatgtttaaggaattaagggcaaaaaaacctagatatgttccacaactttggtgacaataaacatgaaatatggaatccaatttttgaagaatatagccagtcatccctttaaaccacaaccatttttacataatgtatagaattaaaaaacactggtgaatcaactctgtgctgtgatgtgtattaccagtctattggatctgtgtattgggtgtttggggagcatatcgacattatgggcaatgcagttatttcccatgacattttaaaaatccatttctgtattacatattccaatctagtgaaaattacatctactctatttagatttggcatccaacacttgttggccatggcatgtgatgtaatttaaactgctcatgtacatttaggaggagattgatttatagccgtctttgcctgagacaagcacaatttaaactaattcttattgatccagaaaaatttaagattggttttgaaaattctcaagaatagagagttttggatacatttgagccattttgctaagcataattgtcatgtatataaaagcatgaaactgttaacacttatccttctttgccttggcgtctttgttagtcattgcatacctaaaggctaatttctgctccagatgctgtgatgtctgcccagctggcccagctgttaggatatatgctatttgcaaatggcagcataaatagcatatccagaatattttgcaggctggggctttgccattaaaggctaagatatatttagtgtcagggataattgtttggtatattgtaaccagaatggagctgacagaatgccaataggtctagcagagtgactcataaaatagtccaatgaagaaattatttactcaaacatttccatattagcatgtaatgtgcactacaaattggatttcctgtgaatgtacaatcattgtgtgcagagtttgtaaaggtgtctgatattgcaaatgtatcatttaagaagaccaaattgcatcagattctctaaccaagtctcttttagcatctaaaggagtagttcttctaattattttctgattgcaggatagccttgttggaaatgctcaacttggagttgggaagaactgggttctaaattctagcaatttctatgatgacccggtgacattaaacaaatctcccatctttcctaatcttttctatttctggtttctcagtttataatattgaagatacctgcattttaactgtttttgtgttttgtcaaagaaaggtgctttatacatagtctaggtctatttgcttttcaacttttccccaagatcttctgtctttagatgtatagttttttcctgcttttttttgtatgtatctgtttttagctacctaggtattcataaggtgattagaatgcaacggttacatggcttcttaaccacccctaatttagacaagcatttctaagtaggacttctaatattcaaggcaaagaatattctagaactcagaaagtttgcttttatattccaaattattttattgttacatctaaaaaacagtggtgtctgcccttatctgattctggatgctgctaaaatatactgctggacagaaatttgattcattaacttttttggatcttaaccttttaaaggtgcagtatgtccattgaatctacagctttaccgaagcccttgacaaggcactggtatccacaaggaaaggcgaatgttgatatacagtgactggaactgatttttatcaatgtggatggtaccagactaagaaaattatccatctgggccatgcaatctgtctttccagaaaatcactgaactacatatctaataacacagtcagtgagataatttccttttattgagtaatttcctcatttggtagggattttaaaagcctaggggcattttgagcatatggttcaggaacattattttaaaatgtgaattatcaatagaatttcaatacaatcaaagtaaaataacttacttcctaagtgttacaaatataagcaggatatttctacaaaggctgttgcttttgagtcagagttaggagctggagattaaaagcttttcttcagcattgttagagcagggtgcatcattctcaattgccagcggtcaattctctccagacacagttgatcgctcctcccacatgaaacaatttcttcacttgaattcctccaacctcgctggctgtttcttcccaatctcttttgctggttcccagttgtgtcactccccactcattactgaagagccctaaagttcagtccttgaactccttacctatcaacaatcatccttgcttatctcagctagattccgggctttgtatactgatcaattacaaatttgtatctccagcccagacttgtctgctgaatttccaacttgtacattctgctgcctactcagtatctccacttggatttctagtaaacatctaaaatgtgtcatctccaaaactgactttctaatttatcacaacacttactttcaaaaaatacatgcacaccttctgtagtttcctgcctcttaggtcacagcaactctattcttccgcagttcaagccaaaattttcggtgatctccttgactaccctgtttctcttactttctctataaagtctcttagagaaaatcttgttagtgctaccttcaaaatatcatggtgtgagttcaagcaatgtactttttcttttccttgcatacttactccagtggtctaccttgttgaaatatctaagataggtgacggcacgggcctccagggccactcttaattataggccttgtgcctcagggtttcctaggctggcggtgcgttgggggaggggggggcggcggggcggggagggggtggagggttgggaaagagaagaacctccataaaggtagaaaatgattcatcttatatttctctgcaactttttcaccagtgctcagactgaaaaaagatgatgactggtggtcattaaaaagttaattttccgtttacgagcaaacctttttgggtctttgaggtcatatatagaccacgataagcaaattatcttatagattgtatctattttcagctgttataaaagtgttttaaattagaccaaggctatttttagtttttggaaagttagcttataacaaaaatcttgctttttcataaaaaagttaagcatattaaaaaacagaaaaataataccatatggaaatagagttggctgggtgtggtggcttgtgcctgtaattccagcactttgggaggctgaggcgggtgcatcacttgaggccaagcctggccaaacattgtctctactaaaaatacagaaattagcctggcgtggtggtacacgtctgtaatcccagctactgggaaggatgaggcataagaattgcttgaacctggaaggtggaggttgctgtgagccgaaatcatgccactgcactctagcctgggtgacagagcaatactctgcctcaaaaaataaaaataaaaaataaaaaataaaaaaaaagaaagaaagtagagttaaataccacagatataggaagtctagacaatatcaaaggaataagatgatgcgattttgaactaggaaagggtagatgagagcatttatttatctaagatcttttgtatagataagcagagtaaacaatcacccttatatatgtagctctttagtctgcaccaagacactgtccaagtgggaaacagggagactcaagcaaatatcctgttggtgttgtctctttatcctactttaaaaaacactaggatctggactgtgaaatctgagagcagtctctgaagagacacagatgaaagtgaaaatgctgctctattttctatcacccaatttcttgtcacagttactatcattaaaacatattaaaaacatggaaagggctgaaagggaaggtacaaatctaataagatttgtaatataaataaccctcagtatgtttttattcccgattgccttgcctccttaggttctgatatttaaagattgggttaaatatctccttttctgtgtataaggtattggcacaatttttttttttcttattcacttctcctcatcaggcaggtggttgaaactacgtaatgcttgtcttttatggccattttcagagagaatcattttcaccaggggacgatctcctgtgttttttgttttgttttgtttttttacccttttctctcaatctcatctcaaagataaatgggagttaacaactctggttaagattatgctcattttcaaatgctttctttatactttttagccttccataatataaataatattgtggtgctattgtaataacaaatccaggaaaaagaaacaccttactgtcccagactgatcttagtttcagaaaactctgccctcagatagtggttatacataatacttatccactgcacccaatcaccagggtgctattttgtaatgagaagtccagagaattttctgaaggcatgacttaatcatcaaattaccagattttaaaaggctgttacatgtttctatctctgttcattgattctgcatgagtcatcatccttggaaaggaaaatgacatttcccccattggaaattggcagaatacatacagaaggcttaacttctaaagttctctgcatatggggctcttgagctgttatatcctctagaaaccttggtcattcagatatttgtgatttgtatagcgtagaatgtacttcaccaatcttccttctccacagagtatgacaacatctctactgcgttcatatgacctttttatgtttattgtacaacagtatttgcattcgaattggtaccttaaattataatctctaaacaagatttcttggtgcgtttcattggaacagattcaaagaaagagatacaggataggattatcaatggcctggctcgcagggacttatatagtatgttcctgacctctctggtggagtttaatggaaatggctttggagacaggaaatactgggttccagccttgtctctgtggcatacttactccatgaatttaggcaagttatttgtctcttcacatggtcattgagaaaatgaaataacaaatctgtatcagtaaggcacctgggacaggtagcctcttgatggatattacttttctttttcccaggctgtcctgttgccatcttcacacttttgcctaaatgcagagtttgtttgtttgtttgtttgttttttaatagctagggcattatttaaacatttttgttaattgagaaatatctgaagcagtttttaaaaaaatagggagcactggccaggtgcggtggctcacacctgtaatcccagcactttaggaggctgaggcaggtggatcatgaggtcaagagatcaagaccatcctggccaacatggtgaatccccgtctctactaaaaaatacaaaaaattagctgggtatggtggtgcgtgcctgtagtcccagctactcaggagactgaggcaggagaatcacttgaaccctggaggcagaggttgcagtgagccgagattgcatcactgcactccagcctggtgacagagcaagactccgtcaaaaaaaaaaaaaggaagcattatgtttgagtgctcaagcagttttagtatatgaacaagtcaaactcaatatagtcatgccagagacattagctgcatgtgtgggaatgagagtggagtgtcacaggaggctgaaatcagagccaacccagagtgttgaacatgatttcaactcttccaattgacatgatattttttccctttttgaggaggaaaaaatgctctagcttgctatatcttgtgtttgccacctgtatagtgggctgcaaaagcagggggtgtgggagccaaaggcaatggctaattagaaaagtgtatttgaaatgtcttgaatgcttcaataaataaaattaactgacactatagccttaccaaattgatgataattatattgggtttcctgtgattccagtgaatgtgggttttaactaaatacatccaccttattgtcagttcatccttgcattattgtgggagaaaaacttccagtgttcaatttcttgtattgtcagtcatacaacttaaatttttaatttcagtataatcttgccttctcctgcctatttacaacttcctgaaaacatatcgagtgtggatcccgtacgtaagtgagattgtcttcgctaagagcttcttgcaatcacaggaaaaggggaaaaaatgttgttacagctgatcattgccagaaggtgaaagttcaagaagtagagaaaaagaagattgtagcatgtaatcagagttcttggttgcatgctacagaatccattctatgtagtttaatctgggaacaatgcagccagggatgacacctcaaaaatgcccagcctcaacactagactgtcctagcagaaacactactgctgctattacccacatattgtcacttacgacattaaagtccaggggccagaaactctggcacagctcctcaagagaaccagatactctgccgccatgctttctcccaaggagccattctttcatgcagctaatagtttgtgttgcttgctttcaccttcaacattcacacatttgggttggcttggtggctccacattcattacaggctagttcctggggaacctgggaaatgtagttttagctttttgtcttctatagtatagcaatcaaagtaagctagaagggtgttggaatagatgctggttgaactgcttgttagtatctgctcctgatggaattgaactgaaagatgttacaggtgtttactcctcagtggtccatgttggaatgtcactttctgttttcagaagcttattactatatgtaaaaaacaacaacgacaaaaactattgcttttttcttctgcacttgatcaaaattctgtttaggtatccacattttaccattatatgtattcaacagtgcagaatgctggtgaccagttttacttgttaaccaaggcatggctgagtcctcagagacttttaatttgactccattcttaggatgatgtgctgcatttctgcaatggcacccactggcgtgcaaaagaaaaactggattttccaggttaagcagaaacatggacgccatactaaactctgaacagacacattcatgcatcttcttgtccaccagctgcaggaactcaggggttttactacttcatccttttatgcccaacaccccatcagctccagaggcagcttggctgcatgccaatgtcagtgtagaattattctatcctcacgggttcatatcgtttgtcaagtcaccaaacactcagaaatattgatgagtcatctacctagatgtttttgttcatttgtaagactaacttgtacagagttttgagttttcttaagattttagagatataaataaaccatcaattaaggatttagaattcactaaaaataaaagctttaaaaggttgtgatttgaaagatatgcttagtgctggaaggtgtttaagggtcaactattctgacttagaggaagataaagcaagtagtaggtaagggatttgccaaaaaattacatagctggttaatatcaatgctgagattgaaactcaagtccactgcctgctggacggggaatgtttcaaaggtgcttgataccaaagcataggtcctaagtcctcatcatcctgtatgaagcatgcacatgatgccacatggtagctgaggccatgctctgaaggatgtctacatgaaacaaccatgaaaaatcatataatatgggttacattcccaacccacatcttctcaaattcactagaaggtgtccattttgttgacaaaactgaatttgaagtatatgcaataaatgacaccaacattatttttatggctaaaagtacttgaagagcacgcttcctgtttttaatcactagcgttcctttagctgcagtcagccatatttgttgcttacattataagcatatgtttgtttggtttgctctaattctttgccctcttaagggaaaagcaagggaggtttatgaagggccttaaaatgagagaaactaattaattgctgactttttatatttatcagcaaaggaaaacatttctctactctcataacgcttctgacaccaaatgtgcggattttctacacattacaattctcataccaactaggtgtcctataatttaattcagttctggctctggagttagcacagaccccacagtttaaggaatcagtcccacagactgctccacttcagatggtgatcataagcctgggctccctatacttcttactgacaggctataaatcagaggtttctcacgattccctcaagttcaataatttgttagaatggctcacaggactcaggaagacacttgactcaccattgtcagttgattataaagcacacaactcagaaacagccaaatgaaagaacggggtatgtgggaagggccgtggggaatccacgtcctcgctgggctcgccaccctccccgcacctccatgtgttcaccaacctagcagctcttggaacccctttatttggagtttttgtgggggttccattacataggtgtgattgatgacatcattggccactggtgactggactcatctccaacccctctccccatcctggaggagggagagtggagctgaaaattccaaccttttagtcacatggttggttcctctggcaaggggctcccatcctctgagtcaccttattaacgtaaactcgggtatgcttgaaaggggcttattaagagtaacagaagatgctcttctcacccctatcactcggataattccaagagtttcagaagctcttctgtcatgaacagaaaaattctcctgtcaccccatcacttagaaatttacatgagtttgctgggcgcggtatctcacgcctgtaatcccagcactttgggaggccgacacaggcggatcatgaggtcaggagatcgagaccatcctggctaacacggtgaaaccccgtctctactaaaaatacaaaaaaattagccgggcgtggtggcgggagcctgtagtcccagctactcatgaggctgaggcaggagaatggtgtgaacccgggaggcggagcttgcagtgagccgagattgcgccactgcactccagcctgggtgagagagtgagactccgtctcaaaaaaaaaaaaagaaatgtacatgagttttgtgtcaggaaccagggcagaggccaaatgtatattggtattaagtcacaatcaatacgtactttttaaaaatgtaaatttatgtataaatgaaaataactacatttcttgctttcacaaaccttgttgtcaatgtggaatgatttctcaccagtttaaacacagttgagttcttacataaggaaaaatgggaagcagaggttaaaacatgtatattaactgtggtgttctgagtgtagactctggagttcaactatccaggtttgacttcttccatttctgagctatgaggtctcaggcaagctacttgccttctctttactttagcatttcatctataaatttagtatgtcacaggcacctaacttttagcattgttgggagattgagatggtgcatgtcaaatgcctgccatgacaccttctcagagctggtactcaataacagtattaaacattttgtctgggcacagtggctcatgcctgtaatcccagcactttgccaggctgacgccagaggatcacttcaggccaggagttcaagccagcctgggaaacatagggagagcgtgtcttaaaaaaaaaaaaaaaaaaaaaaaagtctatctcctgttcccatgttttcattcattttttaagtaatttttttttaattatggcaatttttttaagtaaaaaaaaaaaaaaacaaaagccaggcacagtggctcacatctgtagtcctagcttcccaggaggctgaggcaggaggatcacttgagcctaggaattcaaggccagcctgggcaacatagtgagaccccatccttaaaaatatatttttttaatgtatggagtacctaccaagtcccaggcactactgtaggcactgaaggcacagaattgatagatgaggtccttattctagtagaactatgaaaattttcttattcagaataaaatttaggaagcaaccagaaaacacatatagacactgtcatgccaggcccctattgattccaacagggatggctcggtaagagacccggagccagtgaatgagacatagggtttatagaagacttatatacagagcattctcggaatgggaggctggataggaaaaccactaccatttgtaaaaagcatgcatattatatagcatgttcacttagcaatcttcaccaagcaaccttcctttaacccaaaacaaaaggcccctgatccctgtatagtctgcattccaaatgataggccaggggttcagatgttcttcatagatgaggagtgaatctccagcttgaccactcctggattcttctcagggtatgcttgagttattgctgttaggtgcatctgccatacagacccatagcatgattttctctaagaagctttgtgatgcatattggtaaacgttgtaaagttttaagtggacttcaattaatttttaaaaagtaaacatacatgaataaatatcatccctcccacatagctttaaattacttctgatatgtccccgatttaaaaaaacaaagggtcagtcaggtgtggtggcttacacctggcgtgtaatccagtgctttgggaggatgaggtgggaagatcgcttgaggctatgagttcaagactagtctgggcaacataacaagacccccatctcttaaaaaaaaaaaattagctgggtgtgatgacacatgcacatgcctgtaatcccagctacttgggaggctgagctgggaggatcacttcagcccaggagttcgagactgcagtgagctatgaatgtaccactgcactctagcctgagcaacagagtgagaccctgtttcttaaaaaaaaaaaaaaaaaaaaaatccaccaagcaaaccagcaaaaagttaataatctagggctttacctacctggtacgaaataaaggaagcataatagagaaagttctcagaactggctgtgcccctggttccgggtgggcaaactccctattacttatataaccttcctcacttgcttgagagaagggagttgctgggagttcttgttagaggttttgcagaaattgcccacagctgagagtttctaatttagagtcattgttccagtgaatggaaatgagctgaaggaacagccgtgacactcactttcagctaagcaaggagacctgccctgggaacaggcggagtgaaaagcccagtcctgagcattacccagctcctttgaccttttctctccagagctacatctctctttccttcccttctcctgcatcacaaaaaaacctgttaaaagttatccatctttcttctttgagcatgagagtccatacaaacacttccatttcatgtatacccaaattccaagtgatcctgaaggaacatttaaagttgaagttttttgttttgttttgtttttctgagatagagtctcaatctgttgcctaggctggagtgcagtcacacaatctcagctcaccacaacctccgcctcacaggttcaagtgattctcctgcctcagcctcccaagtagctgggactacaggtgcgtgtgccaccatgcctggctaatttttgtatttttagtagagatgaggtttcactatgttggccaggctagtctcaaactcctgacctcctgatctgcccgcctcggcctcccaaagtgctgggattacagggatgaaccacggcgcccagcaaactcatgtaaagttgaagtttaagtggcagagagaatgctgtgctgatgaaatttggataattatataactaatttctggcaacattgtaatatgatgccagggtgtcttcttttcttttatatagacaaaatatattgttgagatttttaaataagtattaacgaaatagaaagaatagtcttcagagaaaaactcttttaacgtaaccttttttttttaaccacttccatgagaaattgtcagggttgtcaacatcatgcttcatggcttttgaaatctggactttaacacaaaatccctttatacatactggaaattattgtgctttttggataagattgaggtcttattcaaaattcttacaatcatagaaacagataacacactatcattatctgtgacaagaggataggaatgggaaggataattaaaatgctagcattgggtctttcaaattatgttctctgaatcttagcacagaaataaaatattagaattttaacctctaagatatatttttaaagtttttggctgggtgttgtggctcaggcctataatcccagcactttgggaagccaaggtgggtagatcacttgagtccaagagtttgagaccagcctgggcaacatagagagaactcagctctagaaaagataagagatgagatgggaagatcgcttgaggccaggagattgaggctgcagtgagccatgatcatgccactgcactcccacctgggtgacagagtgagaccctgactcaaaaaaataaaaaaaaaaagtaaagtttctattggagtaagtcattcagtgtctcaaacttttgttttaatgccataattcaactttaatggctctttgtagactaaaattaatatctgcagaaaatagccatttaaaataacttactatttatagaaaaataacataaggcacttgtcatttattgaaggtaatggtttactctgaaatttgtacagtgaggattggaatttttatttgtatttatttaaaacatacttattttgttctagggatgctctttataggtgataactcattcaatcatcattacctatgagaaaggtattattattatttttttactttacagttaagaaagatcaggaactcagaaaggttaaataacttgtcaagttgcacaactgataagtaggtagaaccgggacttaattccaggccatctggccctcagagttcctgcttatgcccccatgcactggtgcctcttgcagcacgtcaaagagtttaccaagacgaatgagctcagaaatttgaacatctaaccagccatctgtctgcccttctggcccttccaggatatcaatgtttcttataaaatggacataaattcctgatgagacaagatttgtatggagagccatgggactatcacccctattctagacacataataaagcaacagaagaaggccacattctcgttaagtgagagcataatgagagcagcagcatagctgctcttttttacaagcagctatgaagctgtaatcctacgcaccttcaacccgtctccccatgagatcagaccatcaattgtggtctcagcaaaaacaacacatctaaatgagaaaaaaaatcagaaaaggtttaacaggctggatatggtgggtcatgcctataatcccagcactttgggaggctgaggcgggtcgatcacttgaggttaggagttcgagaccagcctggccaacatggtgaaaccttgtctctatcaaaaatacaaaaattagctgggtgtggtggcatgtgcctgtaatcccagctactcaggaggctgaggcaggtgaattgcttgaactcaggaggtggaggttgcagtgaccaagattgtaccactgcactctagcctgggcaacagagtgagcctctgtctccaaaaaacaagataataataaaataaaataataaaagaaaaggtttaacaaagggactctctggaggaggagatttatgtagagggactgtgacctttcagttgaagacagacctccaatagagagggctgagggaataagtacccagagtgctctcttttctcttcctccactctcctgaggggactcttccttggcctactggataccagagggtgagggacaccattgatgaaatccataaagatcagcctccagccatggagcagggtgaaaaatggggatcgaactgagtggaccaaagacagatatttgacacagttttacaaatcctatatttcacacacacacacacacacacacacgcacgcacaccttccttcagaacaagtgtttctattcttccactgaaaattttaaatctttgttcattaactcaggttcttcaataccttagaaagattctaaatgtatcttgtcttttttggcacattgctcaagcctgttaaggtcttcttgaattctggttccatcattcaacacagtggtcctcaagtctagtagtagcatctcagaatatgctggaaaggtctttagagtactaatttttcaggctaccccagagacttagtgaatctcaggtaaggctcaggaatgcctatgtgtttgttgttgtatttagtttcccaggcaaccctaatgtagccagtgaaaactcaggcatctgggatcccttgatataaccacttcaacacaaggcatgtgctggacacctttttagaatttatctttgtccagaaacgcagagatcttccactgggactagatttgggagtgtagactggaatgctggaattgcctagggaacttttctgaacttcatcacctcttcctgggtggccaagcctccttctggaatcctctcactaccacagtgaactgctatcattgaagggagcacgttaaatccttccagtcttctagtgcaaaaatgttctaagactcctagatttaccagtaatcttctttacaaatgattgtttgacttttgcattaattttactatttgtattttctctgtgttgtgctaagaatattataatagactctgaaaatattttactggatttgaatcatgtccatcaaacctattcacccatccttccttcttttcttttttccataagtactaattgttctaggagccaagcacattccaggccttaggaataccataaggtacaagacagctgaggtctttgccctcttgtgcttacatttcagtgggggatgcagactttcaaaaagtaaataaaacatctgcaaaaaaaatgttaatatgagtatgtggtataaagaaaacaaatggtactgagcatggagacaattgcagggagggcctctcgaagggtaacataggagttgaaaactgaaggtcaagaaggagccagccttgcagagatctgggagaagagcatttgaggcagaaggaacaagtgaaaatgccctgagataagaaagaaactttagaattcaagtaatacagtgaggtcatttcagagtgacttgtccttattgattgtgtgctgaccagcaaagagatatttccatctgctctaggtcccataaactacctcttcaaatacctgctgaaaatgtttctatgtccccacaagcttttagccagcccatctttatatatgcctataatggattagaataaaataaatacatgaaaactgctgataaaccaaagctttactagtaaatctttgtagctctctctcctccaggagctgatccaggttatatgggatctgaagcttttacaattttaaaggtcctttccaaaaaaaaaaaatgcaaataaaatgttgcaatggccccactcatgcatgtgaagggcccagaaacttcaggctaattggctccatggtaaattcacctgtgcctggcacttgtctttagataagagactgagaatgaccaaaaatcaaaatccacaaagttgtaagtaggaggcaatgaaaaagcatgtatttctgctaatagccagagaaaccatgctcttctccatgtcagctgatgaggagagggagaggaaaacttgtttagatttaactatgcagttattatggcaatcactaagttaggagcaggagaaaataaacaaaagaaaaagaaggagcttgttattttgtaaggaagctgctaaaggaagctttaggcaagtaaaggaaggtaggttaggtaaatacattggaaacaatgtggaatggagactgctgaaagaggtagaggtagaagaaggtggtcgggaccaagccagtgtgggaggtcaggagagtgtggaggttgttttggtggatgcagaggagtaggactctgacatggaaaggtggaggtaggggtggaggtagcgtaggccgagatgggaaggtctgggagtgtgagtggaggcagttggtgaaggcagtagaagaggtggtagggggtgagtgtgcaggcagaggaggaaaggtagtggtggtggtggttgtagggcagagtttggttccatttgggcctgtggagatccattcttcttgccttgtgtgaaaggttttttttcataattacttctgagtctcaaaaaatattcttgtgaataatggagaatcagtcatcttttacattatcaaaacaaagacttatcttatcacaaaatgctcagactgtggtccagtttgggtccagtattttgacatttgctttccaggcaataataatgaggtatatttatttttttgaggtaacatgtgataatgtaatacattcatgtaatttgtaaagaacaaatcagtgtaattgggatatatatatgtatatataatcttaaatatttgtctttttaatgctagaaacattcaaattattcttttaactattttgaaatatacaatagattattgtaaattatggtcaccctgttgatctatgaaacacaaggtcttatttcttctatgaaactgtatatttgtacccattaatcaggctctattcatcctcccacccccttacccttcctagcctctagtaaccaccaatctactctatctttatgcagtccactttttaggtcccatgtacgattgatgtgatatttgtctttctgtgcttggcttatttcacttaacacaataaccaccagttccatccatgttgctgcagataacaagtttttttttttttttttttcattcttttttattggatgactcatgttcaattgcatacatataccatattttctttatccagtcattcattgatggatactttggttgattccatattttggctcttgtgaatactgctgcaatgaacgtgggagtgcagatacctctttattttattgatttcctttcttttggatatatacccagtattggaattactgaatcacatagtggttctattgttagttttttcaggaacctccatattactttccagagtggctgtaccgatttacatttctgccaacaatgtataagggtttccctttctttagatccttgtcagcatctattatccttgtctttttgataacagccattttaactggggtgagaggatatctcattgtggttttgatttttatttctctgatgattagtcatattgaacatttgaaaagtgctcgattgtgaccttgaataaaacctaaaccaggctgggcacagtggctcacacctgtaattccagcattttgggaggccgagatgggccaatcacttgaggccaggagttcaagaccagcctggccaatatggtaaaacctcagctctactaaaaaaacaaaaattagccaggcttgatggcaggtgcctgtaatcccagctactaaggaggctggggcgggaggatcacctgagcccaagaggcggagtttgcagtgagccaagatcatgccactgcactccagcgtgggtgactgtctcaaaacaaaacaaaacaaaacaaaacctaaaccaaacagaatttgtggtcagggagagagatttcttctggaaaatattcttccttccatgatttgtaacaaatcaaatggccatttatgtgtcttcttttgagaagtgtctattcagatatttttttcattgttaaatcagattttttttttttttttttttttactattgagttgtttgagcttcttacatactctggttatcaatcccttgtcaaagggatactctgcacatatttctcccatgctatggactccaacttctctttggggttgtttcctttgctgtgcagaatctttagcttgacgtaatctcatttaccaagttttgcttttgctgcctctgcttttgaaatcttatgcaaaaagtctttgctttggcctggagcatctccccaaagttttcttctagtacttttatagtttcaggtcttatatttaagtctgtaatccatttgatttgatttttatatatggtgagagatagggatctagtttcatttttctacaaatggttacccaattttcctagcaccttcattgaagagactcctttcctcattgtatgttcttggtggctttgtcaaaaatgagttggctataaatgtgcagattcatatctgggctttctattctgttccattgtactatgtgtctctttttgtcccagcatcatgctgatttggttactatagctctgcagtatattttaaagttgggtagtgtgatgcttccagcattgttctttttgctcaggattactttggctatttggggtgttttgtggttccatatcaattttaggattgctttttctatatctgtgaaaatgccatggtattttgatagggattgcattgaatctgtaaaattgctttggataatattatcattttagctatattaattcttccaatccatgagcattaattatttttatatttaattctttcccttttttggtgttctctacaatttctttcatcagtgttttatagttttctttgtatagatctttcacttctttgattaaattgattcctaagtattttatattctttgtagctattatagatgggattacattcatgaattttttcagattattcactgctggtatatataaatgctgataatttttatgtgttgattttttatcctacaactttacggaatttgtttatcagttctaacagttttttggtagaatcttaaggttttcctaagtacaagatcatgtcgtctgtatataggaaatcctaaatcaaaaacctaaacctgaacaaggctaatttgacttttttctttccagtttggagcctgggcaacatatggaaaccctcatctctgcaaaaaaaaaaaaaaaaaaaaaaaaaaaattaaaaagttagctgggtgtggtggcacatgcctgtagtcccaactagtccagaagctaagttgggaggaacacctgagcccaggaggtgaaggctgcagcgagaggtgatcgcaccactgcactactgcctgagcaacagagtgacaccctgtctcaaaaacaaaacaaaacaatcatacacgcaaacacaaaccaatctggatgtcttttatttctttatcttgcccaagtgctttggccatgacttctagtattattttgaataaaagtagtaaaagtgagcatccttgtcttgttctagatcttagaggaaaggcattcaatttttccatgttcagtacaatggtagctgtgggttttgtcatatagcctttattattttgaggtatgttccttctgtatgcagtttttggagcattttatcataaaaggatgttgaattttctaaaatgctttttcagcatgtatcaaaatgatcatttttttcccttggtgctgttaatgtgatatatcatgtttattgatttttgtgtgttgaaccatacctgcatccctgggatgaattccacctgatcttggtgaattatcttttcaatgtgttgtaaaatttggtttgcttgtattctgttgagaatttttgtatctatgttaatcagtgacattggcctgtagttttctttgtttgttgtgtctttgcctggttttggtatcaagttaatgctatccttgtagaaggagtttggatatattccctcttctttaatttttttgaagaatttgagtagaattagtgttagttctttacatgtttgttagaattcagctgtgaagccatcagatcctgggcttttctttgataggagatttttattacagcttcagtctcattactcattattagtttgttgaggttttttatttcttcatagttcaattttagtagattgtatgtgtctagggatttatccatttcttctaggttttccaatttgttggggtatagtttgtagtaatccataataattctgtagtctcagttgctatgtctcctttttcctttatgattttatttattgggtcttctctctttttttcttagtacagagcagagtttcctggggaggggttggtagtcctgcctcacctctttttctctggctgccctctggggtatttcttcctccaggcactactgatgcttcctgtggcttgaaacagggacaggtctcctgctagggaacccaatatggtaaggaagttggttgtcctccttgatctcacttttcccagtgtagaaactgtgaattagtggaaaatttctgcacacttgatgccaggcagatggtgggaagaggtgtcacagatatgtaagtccaattctcttactgtcatcttggagttttttcacttctctgtagccctggaaactgtctcctcatattttagttctagggtattgctggtaaaaaactaggtgctatatatttggttttgtttttctattgggggaaatgaagccaccttgtttctaagccgcattttagaaccagatgtcaaagaactttttagttagcatcaagattctgaatttctttctctctctcttttttttttcttttttgtttgtcagggtctcactgtatcactcaggctggaatgtagtggtgcgaccatggctcactgcagcctcgactgcctgggtttcagcaatccttccatctcagcctccttagtatttgggaccactgacgtgtgccaccatgcccggctattttttttttttttctttttagtatttttgctacaggtggggtttcgccgtgttgttcaggctggtctcaaacacctgaactcaagcaaccaacctgcctcagcatcccgaagtgctgggattacaggtgcatgcccctgcacccagccaacattctgatcttctgtagacactctaacaatgtgttgctttttcttgcttttaaaacctgccaggtggtcacttattatctatcattaaatatctgatatcaatcattttgtgcttttaaaatatgttcctcatatatattaaatgtcatatatgaattaaagttacttttcttaaaagtcaacttgttaggacatatatgtaattctgaaatagaataataattgctgccctccttctcctcctccttcttttcttcctgttctttctccttatcctcctttttttttctccttctccttcttcttctcctcttcctcctttctcctcctcctcttcctcctttctcctcctcctttttcttcttcagatatttgggtgtgctccacggtgtatcaccttaataaaacctaaaccaaacagaatttgcggtcagcaagaaatttcttttagaaaatattctttctttcaggatacgtaacaaatcaagtggctgcaaagccattgtgtgggtcagcattggtgacagcttcatgaatgttaacgttgaatgtcacatgtcagctgaaaatcatcataagcccctgaacatgatttttaaaaggcttatggtatgctcaggcatgacttcggactgaatgtcacgtcttagatttatgcatatgagcctaaaagcctaaatttttaaaaagagcagaaaactattttatgtgtttgtttctgaatactcaagtgccttgctttatctttccactgtgccttctatcctgactactttaactgataaaataatttgcaaagacggacagccatttccttgccagggtacattccagtgtgggagatttctaaatgctaattaattccaacctcaactattttacctgctgtttcaaaggctggcagcttgtattcatcacctgaatgacagctgtttctaacctcttttccctgaaaagaaataagaaattaaataaaccttttgcatgctaatcactgatattctgaactgacagttgaaaagtgttcaagtgtgagtcaaaggcagacttgaattgaaagactttgtctgcaccaactagttgttgaattttgaccagatatttgcgaagtgtagagagacagggttgcaggcaactgatgagacagtgttatcataagtgagagaataattagaagagactttaagtatgttaaatgtctacatttaagcaagttgagcaacataccttttttatttaagttttatagtacagatttttttttttcattttttacctagtgaattttcttccaggtcaatggacagatagaaaaagcaaggctttttaattttttaaaattttgtttacatgctatttttactttaaagtttattaagtctaattaattgtctcataataatggttgatatattgcttcccaaccagagctatcctttgtcaagatgtattttatttctactgtagttttaatttctgctttttacaataatggttggagttaagagcatttgactgattccccctaaacaaagtaaattttatgttaggaccatcttcttatatagtaaacatgcacagacagttttggaaaggattatttaatcttcatggaggattaacatttaaataccaatagtagattatgcttcttgatttgtttaaaggtatctaccactgaatgttttctcctgcatgttcctgactttctataagaccccagatagtatcgttcagtcagaagttgtagatctctcagagttcatgtatttcattaattcaagttgctttgatgatgcctacttttgttacaagaggatatgtttctttttattgttgtcttaaggttatcaccattcagtaattttactatcatatggtaaaatctgaccttccggtgctcttccctatgaattttaacagtcgtatacatttctgtaattagtcactatcacaatcagaatatagaacagttttatcattccccaaaacacttttgtgctatccctttatttacacctgctctccttacccctaactcctgagaaggtatttttgtgatgttaaaatataaagaagaatgagaaagtggaagaggaagaagaagaaggagcaggaagaagaaaggaagggagaggagggctggggaaggcaaggagagtgaagaaaggaaaactgggcgtgcaacccagtgaaatgttcattgaattcttatcaaagattgtatgtgttacctgggacagtatcttcaacacattgcattctcctttcttcatgtaagaagatgaaattgttcaaatgctttctgcagtcattctctaaattggaaattgtatactgtgccttgaaagtggaattatccccaatgataacttttctcatccggtactgtcagtactaggcttgtctgctgtcaatttgacatcatcccatctctgggatgcaatgaaaaggagaaaccaagaagcacataccccagagtcctcttttcttaatagttctgattccagattcccagtgaagggaatgcgtacaggatctgggaggcagaagagaagtggagtctgttgcagctgaatgtgtgggcagatgtgggattcctggtggcttgagaaccactcacttcactgctgcagacagtaatcactggtgggatctttccagggaatttccaggacaccttgcccataagccactgagaaccaccagtctggtgttgctctaggatgaggtttctgggtctgccttctcacccttctgcctgcccgtcccacaacttccaccatgacttttctgtcctttatccactctggctcacctatcatttgtggaaacgccaattcctgcattcaacttgctatttctggtgtctcttcaagtgacttggttttcctgcacaaatccagcctactaaaccatgatttaaagaaaagtttagtatttgtggccagcgtttaaaaattggaagatttctctttgaagtcctaatggctacttttcttttctttctttcttttttttttcttttttttggagactgagtctcgctctactgcccaggctggagtgcagtgggcctgatcttggctcactgcaacctctgcctcccaggttcaagcgattctcctgcctcagcctcccaagtagctgggatttaatagagctgggttttcatcatatttgccaggctggtcctgaactcctgacctcaaataatctgcccgtcttggcctcccaaagtgctgctgggatttcaggtatgagccaccatgcctggccaacttttcctttgagaaatcaagtcaggaaacactggaccagcattctggactgaagacaggggcgtcaaggttacaagtggctgtcaccttagtaagggtgtgattgtccacttcaccagccagcccacttcattgtatcatcttcttggaccttgcagcctttacatttgggtaccttccttgctaaataacatcaccttagtcttatttattaaaggattaccaattgcaaagctgttttctaggaactcctgggtatatggagatgtgtaagaagaaccgaatgcttttaaagagcttgggggaatgaactgcgggagacaaaagcaagcatgtgactgtcctgtgatagcaaagtacttgcatggaatgatcccttaaaggagggtgagaaaataaaatgagaaaataaacttagtagctcactatttgggtatttttgtatactcacatagagttttatggtggcctcacttgttattgatactctaattattgttgatgaaatttatctgcattttagtaagaatttcatataatgcaggctgtgtgaagtggcttatgcctgtaatcctagcactttgggaggccgaggtgggtggatcacctgaggtcaagagttcgacaccagcctggccaacatggtgaaaccctgtctctactaaaattagccgggcatattggcgagtgcctgtaatcccagctactggggaggctgaggcacgagaactgcttgagcccaggaggtggaggttgcagcgagccaagattgtgccattgcactccagcctgggtgacaagaacaaaactctgtctcaaaaaaaaaaaaattgtataaactggaaactcagtgaatgttgtggaataaatgcaaattaatctttttccaagtaagcaaattctcaaagtatgtttctttagaatattttttgttgatcactatctatctagttctatcacatatctgtatctaaataccaataatatatggattttaaagaagatgatatatatcagaaaaaattacacttaaaatttttccaatatgttgtatttaaataaaatacaaggggcattatcaggttaattaattgcagataaaagtaaatatagatatatatgagcctttttctttcttttttttacttttactctgcttggtgttgcataaatatgatagcatataatttttgatgcaggattttttcactttatgttgagatgttttgtatgctgaaataaaaatatgagaataagcaataattattgtaaggtcagcatctgttgattttcttttcctccaggtaaaaatagacattagtttatcagtttagagaaaagaacacaggtgcttcctagtggcaggcacctagcacactccaagtaggaattcatagatatgcctttttaaagtttatttcttttaattcactttcattccacgtgatttattttttgtggagggaagaagtagattcaattttgtattctcccccaatggctgatgaaagtatggacaatgtgtattttgctatgcatgtgaggtgtatgtgtgcatgtacaacacatacacatatatattttggtggagacacaaaggacatttatttgggcaactccaaacctgtttaagtttgatcccttccagatggccggatacctggctgtcggatccttggctcagcccatttcttatctcccaaatatccctttgtgcttctctgagaatacggcatatcttagagctggatgagtttcctgttaggacagctcacagattcgccgagcaagctggggacagtcaaagttgtcttacagaaaaggctcacatcttttaacaaatgtacgtctttgaaaagtgcattttgctctataacaatgtttctggctttgttatagaggcagaacagcaaagtgaagtgattcagaacattgggaagaccagcatgattccatttctgactccggcattggccacaggcccttgtgtatgctctgcaaactagctgagcctcagtttaccttccatacacgggggcaccagcagtacctacctcacaagggtgttgtaaagaataaatgtgataattcaagtaaaggctttagcaagatgattggttcataataagtggtaaacacatggtaactaatagtaataatattggtgctaaggcatttgtgctaagacagtggggctcaaatttgagtgtgcatcagagtcacctagagggcttattaaaacacagatggcctaccccccaccctgcagagttctgactcaggaaatctggattttgcatttctagcaagctcccagggaatgctaatgctgctggccctaaaactgcagaatgaccactgacctaaggcattcagactccagactatttcttggggcaggtgaggactgcagtttggtcatggatcagagtgaaggatcagatgtgggattacatccttcaaccttgggcaatgcttctacagccacgatcctggtagctcaatgctggcccagtgtttatcaagtacaacaaaaataggaagtcctgtatttgcttacatctaccattcaacaactcacaaaaactttctatcttgtttttcacatccttaactttcaaggagcagctccctcgcctgctccagagcaagtatttcccctccaaggcatcagaggactgtcatcagctgcctcaattctgccttcctttggcacagagcaagtatcacatcctctgtgcccccaccagctgattgcagctcctttgaggagtggagattttatttcactctggctccttttcaggagagaatcctcttccctggattttgtcagaggagggttttgggtaagctaagcaggccatgcacaaatacttgatgggagtggggaatggctgtgaaccaaatattttcatttcttcacacttaactgaaacagctgccttcaccttggtgactcatattctaatcaaatccttaactagctgtggaccctcatcaaataccatttgcttattttggctttaacagtgggtggcatctatcacttactgattgtgacagaccactgctgagttcttcacctgcaacatttccttttatctttcctaggagtctatggcctgagaagtgaggtggcaaagatgctcatacagcaactctaactgtttccagccgttctaatgccaacacagacccatctgtcttctggtcttttgctggtgccctctgtctaccaaacctgtggtactgcaagctctaaaataggcctccctgggccaagagcagggtaaagaattacagagaatcagtggtggggcagaaacagggtaggtggcagacagaagacaatgagtaacgtacctaaggaaaattttaggagacaaaggctatgtcaagtgcctagcctaatacaggactttcgctaagtaacaaaactagggtttgaagcctggatcatctgaatcaaattataatcatgccaatggagcatccctgccttttaggagcctgcaaaacaggttgacattatcacaaagcaaattgtgtgtataatcagtattgtccttacacgtatatgagtagatagaactattcaggtggggaagtgttctctcctccattctgagatattctgaaatgaaaggttaatagtcagttatttttggaaaatatgtacacttttcacttcgatatccactcagcaataagtacaaccatcagaattatgctttagcgatttggcttttctctgcccccagccatacatttaaccaagaccaaaatgttcactttagtttcagaaagattttttttctttgtagaacaaaaatgcaagtgacctaaaaagggaattgacttttaaaaataatcttcgtatatctaagtttgaaatgtttaactctaaagttcagcataggaatgatacattatcatttagtgtaagaaattcatctttaaaataagtgtgttattttagcaattgcaaagctttatctttctgaagaacaaattctccccttcagaggcagggttttagtattaaattgcctataaatgttcaaatgtgacttgcaggtcaaaaatcacagtttaagtggatttgatggattttcagacatagtttataatgtgatttcaggtcactacttgttccaattgaaacatcaagctaacagttaataaaaagtaatgcagacgcttgtccaatctgattgcctggtgaattaggctccttttggaaaatattctcatactcatggaagcaaacatgaactggctcattgacgcattcatggttttctttccatatgtttgagtgcctgctatgtgacaagcattgtgcttcaaagatgtttatattttaattttgcactttggcacaagactgatataatgggcatcattgttgagagtgtctgtcatttgaccagcacttaatgtatcttatctctaagctgtacatcaaccctattatatttttattattatttccacttcatctttgtttaactgaagctcaaagaaaccaaaaaacttgatgaacatcaccgagttagtctgtggtcaagttgtgatttcagctcaagtgcatgtcagggcaaatacaatattttttttagactatgtgtgcacttattgtcccttcttgaccatctctagggttgtctatgctgtcacctcagctgatcacttggcagtaagagacatactggctgctagtgttttaacttctgaaaaatctaattcttgaaaacgtggggccaggttgaagagacagggtctgattaaggcagatggcttctaggatgtgtgccatactggctgagttatatcattctaggctactagaatggttcatcctggggttttcagactcatgctgtcttgcagacactggttgttcattagggaccacattatacatctcaggttcaagagagatgactcttccacagatctcttctattgtgggacgtggaagtcttgcctgggtctaagggaatgaccaaattagaatagcaggattgagaagaaacaattaaatctatggtgtcatgggacttggcaggacgtaaacataggaattctagaatattttatcaaagtaagaataacctctgtaaggacaaggacctggtctcaccaatgaaccggcaagaactagagacataggcaagcccacattaggtattattttgttttgttaggtttgttgcttcagagggagattcaagcttggtgcacagaaacttcagggaaataatatcctagtttcaagcttattcctggactgcatcttggacttcagggtctccattgaagagaatacatgaaactttgggagagtaggcctctgacattcttagagttatttcctgggcctctgagatgttgcagggcttgttttagggagaatgttttagtgaaaagacttgaggtcaggatgacctgctgtgacaatcttcaaacttaggagtcgttaaaaggcttctttgttgcttggttggttgaggacttactggcctatgggatctggctttttatgcaaaatcactagggaattgcaaatttagaattagaagggggagatacttcaagtgtatcttctttcagtactgagcttaatatgtagagaaccaaggcagcccactcactaccaacaaacatcagatttctctcttgcctcagtcagtcagttgggaatgagtcttgaggaaatggattgggggattgagggttagagccatggtttactgcagtggtgtgtagtgttcatgaataggccagccctgaatgtatggtttctgtttagaagtttgtgagtaggtatcagatccccatacataacactagtgaagctgaggaacaaaaaatccagttcttacagaactggggtatcaagtaggtaactggccatggatgtaaatgcaggaagctggttatgagtaagccaagtacacagcaagacttgtgttttactcaagcatggtgactagatcccatctcaagcacctcctttgatcaatgagtaatggcttctcagagcactctattgagaagtattctgaggctccgtatcagctaagtgagaaaggatgctgtgcttgattaataatgtctgtcatagtcatgaagtaagagaggagtggtggcacctgtaccacatatttgttatccctattaagctttggaggcactgctgtaggactccgagggcatcactggccccagagactggacaaaatgaacccagataatgtgaataaagtaacccagcaacccacttctccgttgcagctgtttcaaactattcctgtatttttcaagctcatgaaactctgacaatcctccatgcttaaaagataacccctttggctttcctgaaaggaaggaagccatgtgtcatgagttaccctgtgtccctgcctccatcactcagtgtctcttatcttcccccatctttcctcccgtgtttttccatgacagaggataaagtgtcctccctccccttcagggcagcttctccattttttttttttttttccagagcttattactcatcacttaaaatagctgttgtggggaaataaggtttgcttggaaatgcattcctgatcccaagaggcctctcccataccatcctgccctcccctgtgactgtaacttaccagtgggcatgattttcacaaattactatttttctttgtttcaagttaattttgctctgtcatcaagctatcagattacagctctaattctaactaattgtgcatggaatttgcatgattttgtaaaatacagacaaaggaaagtggaaattcggcttcctggttcccaccccttgctgagcatgtctcacataggcctgatgctgtttaattacatgagttggagttcatggtcaagtgtaaagaatgtgggtataatgttgccatctaatagttcaaaggaaatacagcttagatctgttattaaaattgtgttctgatgtatttgaagtgttaacatctatgctgagaacgaggtcttgaatattatattttcagtttatatttgaagttgagattttggattgtgtttacgttttctgaacttgctttcttccttagttgaccttatgcagggaacaacttattaatatttaagtactaatcccagtactgccttccatcaaaagcaacccacatatctcattagcaactcacattagtattgattaaaaaattttcttgcttacttttataatctttatttagctgagttgtacagtatttgtgatatttctatcatcatatatcatcagtggaaatatatttttttcatattttatatgtatacatgcattagtttttatactgtaagttgctcacctgaaagtggtttttaaaaatcataagtattcacaaagagggaagtaaaaggttcaatatctaaaatcatcctttttaaaggaacatgacattctcctaaaacaatagaaagtatactcattgcatatttctttaagacagggaaaaggaaacagttctgttttttaaagatgtggagagagacagggagcaagaaagaacagagccaaaaactacttctatttttaagaaaagagggagaaattgaatatgctttttacaaggagaagacacagtatacagtggtatgtgtcagactttcagtaaaagcaagcttctttactcatatctaataaataatagaccagaaaaaaaagggcctggtcatcttattttataatgaaatgataaaatgcagataaactgaacctctgagtcaaaaatgtattgggttcaaaggccatttttaggatagctttgacctttccataaagtgtgaaaggttcctgtctcccataaagttgtgaccttaaagagcaagatgtattcattgtgtttttaattttttatttatttatttatgtttgagacaggagtctctctctgtcgcccaggttggagtgcagtggtgtgatctcggctcactgcaaactccgcctcctgggttcacgccattctcctgtctcagcctaccgagtagctgggactacaggcgcctgccaccacgcccagctaattttttgtatttttggtagagatggggtttcacgtgttagccaggatggtctcgatctcctgacctcatggtccgcccacctcggcctcccaaagttcagggattacaggcgtaagccaccgtgcccggcctcattgtttaaaaaagttataaaagaaatagagagtgctctgacccatcagatgtgtagttgtggtgtctgtcacacagaattctgtcaagaaaatagctagcgagtcttgaacataaggcattctgaggccaacatccccttttgatttctaaaggacttattgttacttctggttttacaaattgcaaattagggtcttaaaaattttagtatttgatgttagttcactgaactctcttgtcagccaattcataaggagaatttactgcctaccatgtatctgacaatgaaatggagaaccggtagaaacagcccttagtctcagtgttgagatgagtgagtgttcatttagaatgcatttcaccagtacttcttcagtttgattgttaacccatttggtttctaagtcttaggagatatgcaaatgctgaagtcctcaatgttctaatgcggtaaatagatttttttttctttgttgttatgtgagacaccttaagtatagattggtgttaaaacaagtttataataatgctattgatgtgtaaaaacaagctttctaaatgaaaatcaatacctgggacagcttataaactattcttcataatccctttgggtggaattcacagagtggttgtttctttttggtttaaatgctaaatctggccatctttggttatcaaatggaatttgatgatccaaaatgtatttaccacatttgttggatctacttatgaatctttggaaaaactaattgtagtaaaatgggaaaaggctgggacttgtcatctgggtgaacctgaacacggtaaaacctccctgtagaaaacctaatatttgtaatctgtaaaatggaattgaaattatatatatatttaaatatataaattatatataattattattatataattaatattatataattatatataatataaattataaataaattataaatatataaatgtataaattataaattatatataataattatatagttattatatataatttatataaatacaaatatataatatatataatttaggtaaatatacatataatatatttatatttatataaaattataaataaattataaatatataaatgtataaatatataaattataaattataaatatataaataaattttatataacataaattataaatatataaatatataaataaattttatataatataaattataaatatattatatataatttatattatatgtaattaaatatattatataattatttaattatatattatatataatttatattttatataattaaatatattatatatttaattatataagtatattatatataatttatattttatataattaaatatattaaatatattatatatttatatttatattatatattatatatttatattatatataatttatattatatataattaaatatattaaatatttaatgtattaaatatattaaatataatttatattatatataacttatatattataatttataaattatattatatgtactttatataatttatataatataatatataatttatataatatatcatttacataatataatttatataatatataatttttattatatataatttatataatataatataatttttattatatatagtttatataatataatataatttttattatatataatttatataacatatactatataatttttattatatatatgctgtatataactatagttataatttccatcagttttgcccttctcttcttctccatgtttaatgttccatggtctacacacctcattgccctccacacaagttagtgttatcgtatattgcgatatgtctgccatcaagtgtgtattcatgatatatccaaggtagaaggcatgtttttctttttccaggcctgtgtggccaagaagcatttctgaatcatgtgaattcattctgcaacctcatctaccagtgttcacccttcccccactactgccctgaaatttcaccattttaagtttattgctttttgtcttgtagtttctaactctgcgaccagcgctcccccacccccagccctgcaactgcaatgcattatgatttcttttaaatttgtttcaatgcctgagcttggggccccaaaactatagactggactcttacagagctgaaggagagagggggaagcgaaggagttcatctgggataaataaaagaaaggaatgtcagggaaggagaaggacccacaatcactatctcacagatttacgtggatgttttacaatgagattaaccatatttagaatcctagacattttatttttgcaatcagtttttctgaaaagaaagaattcttactgtttagctgaaatacagcttttagctgttttttttttttgtaattcagtaacttatgtgatgtttttattgatttccattatctctcattgtttttaacctagtactaaatggaaaacctaggctagcatttatttgtacaacttagtgcatggtttaaggaaaaaggggaaaaaagccttgtttacttgccctataacctagtgcttacctctgaggtttatttaacatggcaggtggtgacgaactgcagcttatgacatctcttgcaatgtaattcaccactcaatgacgaatgcttctgacaaatggaaacctggtattattctaaaacagaaaaaagatcaatatcatttggatatgggatagtaaaaatggcttctctaaacacgtgaaataaattagccctttaaggtgagaccatattataagtggcaaagataaaatagagtggaatttttgttttccttagaatttttttcttgtcagttgtcagagtaaattaatactcttagaagcagtcctattaccatgccaccctgtgctgttgtttttttagtagtttgcattgttagtgctaattaaaaaactatcttggaagttaattgggggtgatactagttagttgtgactgaggacataaccatgttaattatcgattgtaggtcagacaaagggctaggcttttctacctcttgaatcttaactaaggtcatgagtaagttgtttttaaatcataaaattttagtgttagacaattgctagaggacaagcgtaacttcacatttaattagggggcagttggagatgttagtggtgtgttgttgggcagttgccacacgcttctgatgatgtagtaaatcagcagtgaaattaggtgagactcactacatgaatacacgtttatgtaacagtttttctcagacttcggtcacatgccaccttcaagatatttcctgcctgcaccattacttatttgatattttcctctaagctaattacagtgttactttatttgtacttatctttgacaataagcaataatactcataaattcagagactgattttttaaaattatacattaaaaacacattatcaatgattttttttagtatatgtgctgctgaagtgagcacacaatttttttttaatttagcttttttaatgtaaaaaagaacttggaccacttttaaatacctcacattttaggatacatttatatgatctatatatatgccattcattttcataatttcttagttttttttgtagttttagaaacattgattttccccacatttgtggaaattggaactgtgtttatgtatatgtaatactgaaaaggagacgaaaagaaaacacgtttcacagagttacttcttggtctgttctggaattataatagcgagtactaataagaacaggcacactttgggacattgtatggaagaggcttctagtggcaaagtgatgagaggcagagctgggagcaggaccagttcaccagccacagcccattccagagagtcatagatggcaaaatagcagctctaatcgattggtaatggctgatggctgtttctgttgagaactctgaggcttagtctgggctcagcagggaggagtgcagtgctgatagtgatgtctgacccaggctggaaataggcaggaatagcgagaatgccagggatttgccatgtctctactgtgggacagaaccagtgtgtagcacttctctgggtatcgttttacatagaaataaatgtattttaaattgttttgtttttggagcattggatttgtcatctacttaatatctccatccttgttattttttactttggtgtgtaattttattgtactatgcatctaatatcaatcatcataaaagttttatttttcaattacttttttataatagaagttatattggctcatcctttgcttttctctgaccatattctattaggttggtgcaaaaataattgcggtttttgccaacctaataatatccactcttgtctagtgctatttgcaaggcttatccagcctcaaactgaattccacaaagtggttttggactaactagacctctctggagtctcttgttgaagttgaagttgaattcactcacttatatttgtctgtttctaatgtgtatgtattaccttctgtatttccacactcacatcagtcagaatgcaaaggatgcaacaaatttatgtggtattaatcagtatttttctataaatgacatcagaaatgtaagcggatggtttataaataactaggactatcttttaagagtgggagcttcttgacattggctcaggacaatttccagaaaggtccagattttcaaacatacaaataagaatgtttcctttccgttcagatttcttcttcttgtcctgcttccagagatagatgagaagacaaagggttgaactggcagattctactctagtttaaatgggggcaccaagatttgcatttttaaaacaagtcctggcactcccatccaggcttattcctgtccaagggccaaggttgttttctttggcactgcattcacccttagagcttctggaagatccgctgattagcccggttctactcttgcatgttccccatgtccagattctatccctcaggtaccccaaatcagtatgtaacctattcctaatcagaaatctcaagctttgccctgtaggccatttctcctgatttttccatgctcattctaaacagcagtagttctcacatttaagcatgcatcagagtcacctatagggcttgttaaaacacagataactgggccccacccttagatttcagatcaggtaggcttggggtggggcttgaaaatttgcatttctaacacactcccaggttgttgatgctgctagtctggggaccatacctaagaacactgcaaaatgtttcttttcttcatttcaagccccaccaaactgagactgattatgtaggtgttggcctagttgccctctaaatgatctttatttatctaaatagctgcttgcaacatgtaaaaattcaaaaggtgaaaagtatataagaattttcagcagggattcttctggtgcccctgaattctttttgttgttgttgttggtttgtttgtttgtttgagacggagtttcgctcttgttgcccaggctggagtgcagtagcgcaatctcggctcactgcaacctccacctctagggttcaagagattctcctgcctcagcctcctgagtagctaggattacaggcatgtgccaccatgcctggccaattttgtatttttagtagagacgggtttcgccatgttggtcaggcttgtcttgaactcttgacctcaggtgatccacccacctcagccccacaaagtgctgggattacaggcatgagccgccgcacccaactgtccctgaattcttcccaccattcctgccagctcctctttcccatccagtcctctgtcccactacctttatttcttctttttccctccctccccaaatacaagcaaaccaaccaacaaaaacccagaacacacataggctggaacacaaggggataacatgccttgaattgcaatgccataaagatgtacaactctagggacgggatggcgtccacacagaagcaatgtgaacaatgccccctggagttgtacaacgtggggccttgttgagcagtactgtttcgcaacacatagtagcaagaatcctctttgtaagccctattccatctgcctggttggttttggcaggatggctgactaacccactagtgggaatccacagctaggatagaccctccagctctttggctggcttctaaaaggccacgactttagaaaacccatctgtaatacctgatttaccacaagaggtagccttaggcctagatcagtctagacacttgtcagcagccccaccttcagtgagaaggactcagaaaacactgtctcattggtttactcatggggaatcttcctggtcccacccaaggaaatgcctcctgtacaaattctcttcccaaagagactaacagcaagagaatcccagaaggggtcaaaactcaaggggtcatattcctgattccttatattcctgattcagtttaaatcaacccctcaatttacacatcaatctgtctaatccctctacagccctttggctcttctccacacccttggctgggaaactttcttcttccctcctcagccagttcacacccttcattattcagcacatgttgaaatgagcatcatcggagctaccactccctggatgcttcgtcatatcactgggagagaaggtggagaatgttcccccagcagaaagctcccacaccatcctgtgtgcagacttcccagggggaggtctgtgctgtatatcttgttttgaaatgtaatgacttagtattttccactgaattcccttgcctggtcagcttccacagcatatctgtgctatagacaataatgaaaagagggttttcgtatgttttttcttttattatatggaggattaatatgctgcaatgcatctaccatattgtgtgcctttttcacaaacatttttattagaaagatcaattctcagcctagatccaactatgatacttttaaaatcctgtcattatctcccctctgctaacgaattcaggggaagaacaggtttctggtttctcattatttctaggggtagaattccacatcaaatatagaaaagcatcttatacatggaacttttttttttcctttggaaggggggcttcttctgtgacactatccacacacttttttagtgacttctttttcatcaattaattcagattgtctgaagactagaaattggggctttggcaagggtgaacagcgattaaaatatatatctccgctcacatttctgcccacatggttctttttctgagagagtggttaggaacagtgctagtcttgctaaaactgctgagtttcatttcacactaataacacctggcatctttatgtgctaaggataaattaagcactcagtgaacacagggtagacatgggttttgctatgatgtagcttattctgcactcattatatagagagagaaatctgtgttgtgaaaatgtgtgtgtaggcatgtatgcaacattgcaaaaaatattaatagctctggccattttgctgattttagataaaggtagcactatcatatattccgattagttattaatagaaatactgagaatattagaggtgaaatggcccttaaaaatcatgtagtccaaaaatctcattttacagactgaagaaattgagaaccagggtgattattttcaggaattatagaatatattctgtgaatttaggcagaatcaaaatagaactcaaagatttaatacccattccagggcactttctaccataccacgctgttcctcaaataataaataaattattcaaatacacgaacattatgtcatttttacagaattctaagttgtgtgttttttgggttgttgttttgttttgtttttgagacagggttttgctctgccaccaaggctggagtgcagtggcgcaatcacagctcactgcagcctagacctcctgggctcaaacgatatcgcccacggcccctcaactccccatcccacttcggcctcccaaagtgcaaggattacaggtgtgagtcactgcgccagcctaagttaggtgtttaaatgattctaagacacacattctttcacattttgaaaatattttattttgaatttttagacttacagaaaagttgcaaaaataattcaaagagtttaaaaaatatacacctctctcatcccactccttctaatggtaatatcttagaaaaccatatgacaattatcaagaacaagaaattaacaattatacaatatcaataactaaacttcagaccttatttgaattttgccagtttttctactaacctttttgtttgtttgtttttgagacggagtctcactctcgctcagactggagtgcagtggtaccatctgggctcactgcaacctctgcttcccagtttcaagcaatcctcccacgttggcctcccgagtagccaggactacaggcgtgtgccaccacacccagctagtgacctttttgttgttgttgttctaggatctcacattacatttatttgttcttaatctcttccagcctataactggttctcagtcttttcttagcttttgtgacttggcacttttgaagagtactcctcagttatttctgtacaatgtccctcaatttgacatttttttctagagagagaatctcacgctgtcacccaggctggagtacattggctcaatcatagctcactgcatccttgacctcctgggctcaagtgatcctcccatctcagcctctcaagtacacacacatatatatagtatttatatatatatatagtatttatatatagttatgtttgttttgtttctgagacagaattttgctctctctctctctctttctctctctctctctttctctctgtctctatatatatgtgtatgaaaagttacgctataacaagtgtggaaataccaagcaaataaaagtctgtaaaaagaatacctcctcttcctcttttcttcctcctcctcttcttccttttcttcattacttcttccttcttatctttcttattctcttcttttttttctttttattctaacctttctttcttcttttccttttcctcctctccctcctcaccaatgctctttctctcgtctgtccactttcctctctccatatttcacctactaaaatagtatttatttggtccacattcccgtaaaattgctgttgtttggggaaaaaaaactctaaggaaactcagaaagctgtgttacccaaatcatttacaatttgagttggttggagaatatgccatggagaaagcctgttcggagatgattagcatgccagtccaatgtcttttcctacttaaatttttaagatagtttaggactccgataactattatgtcttagctagtggttattcagaaataaaataaaaaaactgtaccatactttttttcaccaagtagaattagctcagagcacagtgcattgggtgtctgggcttctggtaggtgaggctgggatgtgcaggtagagattattgagtaccgtagtagtacagcagcatccaagtttaaatttgagggtgggtgtcagcttagaaaatctgagtgcttgcaagggctgagaatttctccagcctttcctgcagctgtcagaagtgccctgttttgcccttccctcacacctcctcccaataattctattactcaggggaaggagacctgggagggtgaaatgactcattattctattagacaatgggacgcttgggttttgactaaggctgctcagactgccagagtcccgacctccatggcaatccagaggcacaggaaatctgagatttaaagttgtgaactcagtattgacatgaaaaatgccacttgtgttgtgctgaaacaggtatgctgattatgtaacagcttccaacacattccctgccggtggtgggttttgattgacattttatgagccttattactcttgaaaacaatactgaaaatgccatgacaagctcaggatggaaatatgaacacacgatcctcttcctgctgaactagaaaatagcttttcgaaattcttggaagaaagtggaaagttcttcatgtagattcataatgatcaatctctttttgtttcttgggaggagaaggatcctcaaatcttatagcaatttagcatggtctagtccccagaacttttctttgggcttcttacaacttacaaataaatgttgacttctaaagtagagagggaaatgcataggatatcaatggcttgataaatatttacagcaataaattacagttttttgcattcatagtaattccttggtagagggagtttattgtttaaacaatatagagatggaaatgcagcagaaattcagatttttttctgtgtttttttttcttctctgtataaggtgattttttttcttctctgtataacaaattttcaaagtagaatggaggttcaagaatgtcaatgaaatataaatggtatggtgcatttgctttcattgaattgttggctctccttaagtatattaggatagcaaactctctgaattaggatttcaacctcttcgatttccttctgattttgtgtaactaaaatatataaatgagactgcacacaggccgggcgcggtggctcacgcctgtaatcccagcactttgggaggccgaggagggcagatcacgaggtcaggagatcgagaccatcctggctaacacggtgaaaccccgtctctactaaaaatacaaaaaaattagccgggcgtggtggcgggcacctgtagtcctagctactcaggaggctgaggcagaagaatggcgtgaatctgggaggtggagcttgcagtgagccgagatcgcgccactgcacttcagcctgggcgacagagcaagactccatctcaaaaaaataaaaaaaataaaaaaaaaataaagagagactgcacgcacactagcatccctggattccaaatacctatctgctttgttataaaattaatagtaataatagcagcaacaatggaaatagtagctagatttattgagttcatattgtttttaacttgtgaacccaagcagtcccatagccactgtgctatactttagtgttatttttaaaaatcacgctcaactaaaaatgggaagcccaggcagctggtttggtgtcacttctctgctaagatgaatgccctctgcaccctcaagtggtgaagcaggtataggcggaatacatacagaatgaaaaactgtatttgtgaaacactttgaaggaaaggtgttgtgaaaattgtgttttgttaagtattgagggatatggaattagaaataatagtacagttgagacagaaagatcatttttctgaagcacatgtttagtgtcggcaaaggttaagctgtttttgatgaacctgttttcatgtgaaaattactataaatggtcagcagatacttgcttttaaggagcctacttctgattggtcagccagataagcgtgtatgtggtgattgttaagaagcagctggtgtcagtttaaaagaatgatgttctatcctcttccgtcttgaccagtctgagaacagtaacatcaatatttgaagttatatattcaatattcattacaatattctgaaactagttgttcatggaaatatatcggtaacttaacacaattccaaatgccattttttatagttatacttttttgctgtttcttaaaatgatattactagatccatattctaattgtttccaacctagggacggctaaaagttatttttttttctttttttttttttttttttttttttgagacggagtctctctcagtcccccaggctggagtgtagtggcccgatctcggctcactgcaagctccgcctcccgggttcacgccattctcctgactcagcctccctagtaactggggctataggcgcccgccactatgcccagctaattttttttttttttgtatttttagtagagacgcggtttcactgtgttagccaggatggtctcgatctcctgacctcgtgatccacccgtctcggccttccaaagtgctgggattacgggcgtgagccaccgcacctggccttaatatatatttttataacttcatcatagaggtgataaattttatccagtataaaacagtgcattttaaaaatctcattttgcttcaacaacatacagtaactggaagcatggctactgctatcttatttaaacaagtataaataaccaaaatctacagagcaaattatggtgcagttgaaaaatatgactacttttcagtggggtatgtttatatgaatattcaaggagatgacaaatatttacatttttcattcctcattattaagaacttgagaaaactaacgagtatttattactcctgaagtgaaagataatgagacaaaatcctgaagacatttctcttttggataactgtggttttaaactccataagcaataaagccactgtcaatggaattattttagatgttatcttttgacgatggattatgttttttcttgtctttttaatattaatttacatttagttatgtcatatagtaaagcatgctaatcttaagcatatgtacttgtgtaaccacctccgatgaagatatggaacatgcctataatcccagcactttgggaggctgaggcagggggagcgtttgagcccaggagtttgacaccagcctggacagcatagtgagactccatttctacgaagaataaaaaagtcattaaagcatggtggtgcatgcctgtagacccagctactcaggaggctgaggtgagaggattgcttgaggccaggttgtcaagggtgcagtgagctgtgattgtgtcactgcactccagcctgggcaacagagcaagaacctgtcttcagatgcttcttcatcacccttctcatttcatcctctcttcccgtacaaagcagccattcttctgagctctgtcatcatccattagttttgcctgttcttgaacttcatgtaaatagattcatactatatgttctcttttgcatctagactcttgctcaacaagacattttgaagtaatctatgttgttgcatatacaaacaattcattttttacactaccatgtagtatgccattgtatgtacaggcatttttttatcactgttgtgccaatgggtatttgaatttttcctattcataatttaacaattatgtataaagctgctatgaacattcttgaagctgtcttttcatgagcaattacattcacatttctctgaaatatatacaggaattgaattgtttaaacaaataatttatggtatgtgtgtaatagtggatatgtattgatgggtgtgtactgatatttcaatgtggttttaatttgcatttccttgaaaagaatgacattgaatactttttcatgttcttatcagccatttgaatctttttttgtaaatgcttcaagtctttgctgattttaaaatcaatttctttctaaatgatttttgttagttttgtttgtttgtttgttttgagacggagtctctctctgacacccaggctggagtgcaatggtgccatctctgctcactgcaacctccacctccctggatcaagcaattcacctgcctcagcctcctgagtagctgggattacaggtatttttagtagagacggggtctcaccatgttggccagactggtctcgaattcctgaactcaggcaatccgcccgcctcggcctcccaaagtgctaagattacaggcgtgagccaccgtgcctggccggtagttttgtttgtttgtttgtttttgttttttttgaatgctttggatttgagtccatcatcagatatagactgtgaatattatttctcagtctgtgtcttgccacttcactctcttagtgtcaacttttgatgaacagaaactctacaaattagacttaaatgtaattttttaaatgattaatgattgtttcctgtttaagtaaacttgcctattccatttcttattttcttatttatccaattctcttccatgctagtgcttttgagttctatgtgagaagtctgccaatttacttcatattttcttaagcaaaatattttgaacaaaacttagctttcctaatgactcagggtcctcatttttaatagtaattactactgtccaataaattttatataacctacccgatagtgttgttaccaggataaggaagatatgtatgaaaattcttgatacatgcaggctgttgtcctttttgttctactctaatacttcttattcttattaagggtataggacagttattaatatttttatgctcagtggttttcgacaactctaaattttaagttattatatcaaattctgggctggacaggtaaggtgtttgccatacatgattgcaattgtgaggtttctttgtgtataaagtctttaaatttatatggtaggtcaaaaaacatattagctgataataatacttactttcaaatatcacttaaaatttctcttcaaaagcatttttttaaatctctttttaacaccttgacccaatgaagtaaaataaacaagatgatactcccgttaaatgtgtgtacaatcattcagctgctgtggcagaatatacaacagttctcagccctgtgtggtcctttctcaatttgtcactcaattgattgtactcatacatgtgttagaccaacatcctcaataccgtttgttggttagcatcatctggggagactgtaaaagcataagaatattcagctaccaacccagggggttctttaaattagtgggactggggtggtgtccaggcatcagttgtaaaaaaaaagaaaaaaaatattttattgtgcaacctggacgtgattctcctgttggcttggggcagggttatgcaaacttcagcatgcattagaatcacctgaagggcttgttcaagcacagactggggggctccacccccagagtttctgattcagtaagtctggatggacccaagaatttgcaatactggaaagttttcagatgatgctgatgctgctggctggggaccacagttcgataacctctggattagatagccatcaccatccctaccacaagtaaaacttgctggtcattctcatctgttgctgtctcccatctgcctcttctagccctggggttcaagttctgtttgtttgttttgttttgttttcacgcacaatactaagctatttattttctcacttgctcagagagagctttaggattgactatgtattactttacctcttttcaaaagaactaagtatctccaatatgaactgtgagatgacttttgatagtaggtatttcatctcaaagagtgcaagtatgtcaaaagaggggaatttgagaataaaacttagaagcaaatagagatcaccttagaactactcattcagccagaaaatcaggtcacaaaattatagcacctatctccagtttatatatatatatatataaatctgtacaggaatagaaaaaaacctggacccaaacatcagagtgttggtaatggtagtatccaggtatttggggttatcaatgatctggtggccttttgttatctatatcttacgattattttttccataggaaaaactgaataaaagtaaagcaatttaaaagctatataaatgcttttacacacacacacacacacacacacacacacacacacacacatatataagcatttattcagcacagatttgatgaaactcctctacctatgaccatgccaagcataacagggtctcagaacacagaagcttacagacctgttgagcagataggaacccccagtttatattttcatgaaatctagtaaaatgttgagtctctttgtagtcgtaagaaaaatatataaagacattaatgatcattgactgtgggagacaatttcttaggatgtaagtgcctttgattttttttcctaaagaaaagttgaaaggacttggcctggtaaaagctgcttttaacttgaatctacaccttttatttttgaagtcttaaagagttttattcatttatattagattcagctggataaggatcagtttctttcactttgggtcatgggccctccaagaatgaaatgatactttattcactggaagcatagaattgctttaaacataaatgaattatggctctgttaataaccattaatgttcacatctccaaaaggtagcaagaccctatttataaactaaattcactggttggttgacatatgatccttgtcctcttccatcatcgtcatcatcatcattgtaatatatagttgtattagtccattctcacgctgctatgaaaaaataccttaaatttataaagaaaagaggtttaattaactcacagttccacatggccgaggaagcctcaggaaacttacaatcatagcagaaggcacctcttcacagggcagcaggagagagaaagagagccaagcaaagggggaaaagccccttatacaaccatcacccccatgattcaattgccttctaccaggtccctcccatgacacctggggattatgggaactacagttcaagatgagatttgggtgggaacacagtcaaactatatcaatagtatatatcgttattagattctaaagtcagcctataaaataaatcaaaattcatgttaagtcaaaattaacctcgtttaagtgttttttcaagctactttaaaaaaggaaaacaatcttgaaatttccttaagaggctttttattgcagacctacatttatcaatgagatcaacagagccattttttcctccagtgttgaagggatgtatttcttcagttcaccagaaaaagtgattggtttgtattcatattcatgttgtatgaaaactatgaataatgtctttatttttaatgcaatttatttatttgattaaattttttaaaaaatttatttagtcattcattgatttaagagagtatctcactcactctgttacccaggatggagtgctatggtacagtcatggctcactgcatccttaacctcttgggctcaaacgatcctcctgcctcagcctcttcagtagctggaacgacaggtgcacaccagtgaggtctcactatgttgtccaggctagtcttgaactcctatgctcaagcaatcctcccacctcagcctcccaaagcactaggattacaggcatgagccaccatgctcagcaaaaaaacagtgtctttaaacactctgaatcactcttagctatgatacttacactatgaaaggaacatgggaactgaatacaggcatccctttgtatcagtgagggattgcttccaggatgctcaagtcccttttataaaatgacgtagtatttgcatataacttacgcacattctcctgtagactttcaatcagtcagtatactccagattacttcaaatacctaacaaagtgtaaatactatacaaatagttgttgtactgtttagagaataatgacaagaacagatagtccatacatgttcagtacagacagaaccatgcatgttttttttctgaatatttttgatgggtaaccgtcaccttaagaggtgagtagttgcatgggtaaccatcaaaaatattggttgaatccatggatatgaaatccatggatatggagggctgattgtatgatggaaatggtttatccagacctctcagcccattcaaagagaggaatagcagattccatttgacattagtaggtaaagggaggggggggactctgaattacttattctctctaactctttttccttctgttctaagtatctattgatagttattaaatcaccgcagaatccaggggcttaaaataatgtatcattatatcttacattcctgtgggttgactgggttcactggggcaggtctcacttggggtccctcatgcaattgtagtttgtaggctgctggggcttgagtcatctgaagactcaacctggctggacatccaagatggtattttcacatagggcccaaagattggttggatcaggtgtgacatttacatagcgcatggggaagctggccaccccaccctaatcttataaaaataggttctttgcttggccggcggcatgttgcttgcttcttactacacaagttgatggcaaagagaagggaaaatggagccgccatgttggacatgcctagacccaggtagccttttcctattggcacaactgccggcattcacccgggcaagcttctagcttgcttgtctatgtctgcagctcagttttacgggctgctttttgttagaaaagaaaatgatttgggggcttcttttcattaaaaggaaaaccttaccaagtactcctctaccctcactatctgcctaaataatttcttcttaactcctatatcactggttttgcctgctgtaaacatgccaaggggcaggaagcagaaaatgccaggccattaggggctgtaggtagaactgccatagtgctctttctactcaattctattggtgtaagtagtcacagagcctgcccagactgaagagagtggagaaaggcttctcttgatgtgggaggggcaaggtcacattgcattaaaacatgtgggctgggagatattgctgtagccatctttggaaaatacaatcgattataccctcccttcctctttctcactctctttctctcatctcctctcttttctcaccttcctaagcatagggttgggtctgtctgtgtgatgtaaattcatgggtgactcagcagcactacaacactttctagtatatttagccctttacatatattttacatgctacataagtctttatttacattatactgaaggtctaatgcccagaaacaagtggaattcttttgtttaatggtttgatatgtcctataagggatctgaggtgactcagtaattatgatttcaaaataattaagaatattttgttgaaataatctctgagattctacttcaattccagggtatacagcagagcactttggattcatttaggaggagtgcttacaatttccatcttactctctgcacatgaagagaattctggaagcatagatgcttcactactttgagtgaatttagcttgacacagctgattagggaagacatcaccaatggttgtcattcatctgtgctttgctaagtggcgtgtcatctaaaacttaaacagccagaaactcgctgttatcctttcattcactgagacaagttgatatagaagctactggaataattaagtgatacttttacactatttgcagttaggaaaagttttatatacatttctttatttgtttctacatcctagcaagctgttattttcatcctcattatacagttgaagaaatgaggctgagaaatttatcataaatcatacagttaattaagggcatgtgatttggtcaaccatctgaagttccattatgccacactgacacagaaaacaaatattcttaggattagctagagtgcctaagaggtgagtagttgcttttttttttttttttttttttttgaggtagagtctcactctgtcacccagtctgaagtgcagtggtgcgatcttggttcactgcaacctgggttcaagtgattctcctacatcagcaccctgagtagctgggactgcaggagcgtgcctccacacctggctaatttttgtatttttagtatagacgagatttcaccatgttggccaggctggtctcaaactctcaacttgaagtgatctgcccacctcagcctcccaaagtggtgggattacaggcatgagccaccgcacctggccaagtatttgctttttatggagtggcagaggaagggtttgctttcatatctttttgcttagacaatgaccacttgattatgaaaattctgctggaagtgaaatcagggaaaggtttcagagagagattatttgggaacagtgtgaactaactcagtcttcacttactatgaaggaaggacagaaaagtcatttttccatttaataaatacttaatgtgtcccctctgtatggaagatagggctaggtactcttggagtaacatatataaaaagcacagctctgcagaacctcaaggaacttaagtttagtagaagtcaaagacatttttactattaaaatagaatagaaagtgtcagttactaccttatgaaaggtaaagtgaagtaagatgacatagaataatgtttccaaaaagaaagaacattcactttggctactggaaaattatggaagcctgcctgggatgaaagtattggtgttggaaggtggaaaatatagggaagaaattggacctggaagagtttggaaattgctgcatcactataggcaatatgaaataacagattgaactaatgcaatagccagttggaaagggtcaagtgaaagctgaagtaaggaatacgtggaagtagattctgtggcacttgccagttgattggatgtagcggatagcggagtaggggattgtctcagggacccgaccacctcttaaaggcccacctctcaatactgccactgtggggattaaatttcaacatgagctttggagggcaccgatgttcaaactatagcaggaatggaaaaagtttgaatatgggtcaccataaagttggtggtgctgtcatgaatgtcaggaaatgacaatgggtggagtatgtcacggcagaaaatgtatgacatacccagaattggatattcaagaagtgtctatttacaaaggagccatttcagaaggttttaggatgggggcaccacaaaggatagtgcagtatcctagtgcagtatctgggccttagtggctgattttatacttttgctatacgtgaattgacaagggaaataaataattacctggcctagaaagggagggtcatgtagtgacagccacattgcaggaagtgacctctagtgaagtaaaatggaccacctcaggcaacctttcagtaaaggagcaaagggaatacataccttgactttattattctctcctactgcagtttgcactgcaagtccaagggcaagagagtcctgttgacgtagtctgtataatcagcttcttggggcactgagcaaggtgggcaagcagatatggatatgtggatgccatgcagactgtgtgaactctagaactgagcctgggttgggtctagcagagctgtttgcacaaaggcacacacacaatgacagacaagctagacccttggataatggatttatttagatcagagttactttaccttggcactattgacattgtgggttagataattctttgttattggaggttgtcctatacattgtaggatgcttatttaggggcatccttggcctctacacactagatgccagtagcatgcacctccaacccctgacaaattttggtaatgaaaaatgtctctaggcatcgcaaatatccaccggggtgaggggcagggtgccaaagcaaaatcacccttagttgagaaccactgattagaggctggacaaaggaaggtgagccagagaaaaggaggccaagaaccagcaggctgagaggaggaacagacacttggggagtgtgacagtggttgacgtggttgcagcccacagtgcgtatccatagaaattcttaatagggactgggcctgtgaagtggagaggcagaaaggagtagatcagacggcagcaggctggggcgggcaggtgggaaagcagggcagccagcatgggcctagtttggcagcagagggaaggcgcagggaagcagggtaccttcgacaggtgggtttaagatttgcttgaggacagagagatttgaacatattggtcagatgaggggaggaaagcagtgaaaggggaggttggagatgggtagtgaaatccaccacctgcagagtgcatgtgatggccttgttctggggctttccatgtgttacagcattcgactctcacgacctctctaggaggttgtcagggtgggtgcccttatgatccccattagcaggtgaggtaattgaggcccccagtgtttactcactcatacctagtccacacagctagtagtggccaagttgtatttgaacctgagctgaagcggagtgagaacattccagtgagcaaaagaaggatgcgtgcaaacccttagaaataaggagggaaggtgaaagtaagcgaagttatggacgtatttgatgtttgacaggaggtggattacagttcccggctttcaacggaattaacaggctcaggaaggtaggcgttaacaccctctgcagaagtagtcttggcagaggccagcatagaggatattccccaagaggtggctccgacttcaaaatgtcaagagcatggttgttcccgttgtctgtgccccagtgcttctctgatcctttcaaaggattgttgtgcagttgtttttctcatttttgtgtataaatgttttctcttactcttgtaacaaattaccacagatttcatgctttaaaacaatgctaatttgccattctggaggttagtagtctaaagtcagtttccttgggctaaaggtgaggtgttggtggtgctggtttcttctgaagtctctgagggaacatttgtttctctgccttttctggcttctggtggctgcctctattccttagtatgtggacccttcttctatcttcaaagcacatcactccagcctctgcccccatccttgtcatcacattgctgtctcctctatgacttcctgggtcccttgtacaaggaccatgtgataacactgggcccacctgtgtaatcactgtcatctcagggtccccactgcaaggtctttagcttaacccaatctgcagtgtccctttcgcatataaggtgacattcacagagtctggggaacaggatgtggacatacttgggggctatttttagcctacctcggttggtttctatgtaatattctagatggatggaaagatggtttagcctagaggtgaaggacatgacctctgttgcttagaatcaaatcatcacttcccaactctgtggcttgagtcagtcatttacccttgctgtggtcccatttcctcgtgtgtaaaatggggatagtagcattcacctgtgttatttgggggattaagtcaaggcatgcacagtgtggcaaatacaatgcggggctcttactgagtattcagtcagtacagtcaattattattcctgcaattattttatataaacattttcttcaaagtattttaactagaagagtgctgcccatctgattagttaatagattaagctgtttctctaaaatcaatgatcacgtgatcgaaagatgtcacttcttggctgatagaagaaaatgcaaaaacagggtttgtgtcactatggttccccaaatcatagatgattaccttcaagttagcatgaagtcagaactgacattattgtcaggaaaaaatctgctttgttttcctcttaagaaaaaattgtaatcataataaccttccctgcccagggcaaagcaaacaactaaactttcagcaaatcttcaccagactcagcacatcagatcaagctctttttaacaccttgatttttttttttttttttttttaaatcactgtagcacccaacttagcttcttctttttatgctgttttcttctggcctctgagatgtcatgacctttttaggttcatgttagtaggtaatatttaagtacaagagttctgaaatttaaaaaataaaagaaaaagatacacacacacacacacacacacacacacacacacacacaattagggtttagggtgacctgaagattatcctggacaagctgaatgtgacttgggtaagtcacatatcctctctgcctcagtttcctcagctggaaattggtggtgatgatacccacattatagggtgttatgagagtcaaaagagataaccgttgtacaagtgtgtgcctgtgcctggcacactgtgaacaacaatgaacaagaatggcgatgatgatggcagcagtgaggatcatagtgggagtaaaagggaagatgaggaaggaccatcagaaaacgaaactgggaagcctaatgtggggagaaaaagacaaaacatgaggaaattattcttcttatggcttggtgtatggataatggctatctatgtattctgttgaatttttttttctaatagcacaaatgtaatgatattttagaaaacaaacaccattcaaaaatcctttgttttatttggaacaaactttcaaaactcatttctgcctaggttcatattgaagcttcagattcttccttaatatgtgcttggaagtaaacatgatatggagctgtaatccatgtgattaattcagtgaaaacaattaagctgaaactagaacctagaacccggtggtcttgacttttttcctcatgctgccatcattttaaataacataagatcaactgtttaagtgagaagctaatttacctgccagcatatttagctttgttgagattcttccatatcctacagataaaaaatgagattaaaccatgtatatgtatctattcagtactaaattattctgtatgaaaagacaagtactgtgaaacttctattaaagtggccacaagtatccctaacatagaagtagtccccctctccgcgccccgccccccccactttttttaagttggctaatttaatgagatatttacattgttatcagtaaccactaaggagttacaaaccattacttctacaggcaatggccagtgtaattaaaccttttaaccttgctagttttcccagtttgccattatcagtcattggtcacagtacatattttttcattattagccacaaactagctatgtgaccttaaaaggttatttaaagtctccagactttatttcccaacccccccaccccaccccatgaaaggaagaaggaggagacaatgatccctgtggtccatttcatctccaaaacccaagaccatggttctgcaacagtttaacaatctggttaacatttgaaagtaaatgaaaacgagagaaaacattgcagctctgccagcaattttctctctctctagttggataaaaactatccaagttgtccctgtttgcaaaggagggtattattatatatatatataatatattatataatatataaaatatatatattatataatatattatatataatatatatcataatatatatcataatatatataatcatatatatatatatttaagagacagggcctttgctctgtcacctaggctgaagtacagtggtgttatcatagctcactgcaacctcggactcctgggctcaagtgatccttcggcatcagcctcctgagtagctaggactacatgtacacaccaccatacccagctaattttttttttttttaattttttgtagagacagggtctcactgtgtttctcaggctagtctcaaattcctagcctcaaaagatcctcctacctcggccttctaaagtattgggatgacagatgtgagtgcctgagcccagctgtgatttatattttaatgaacaaaagattagaataaaatttgtaaaatttttatttctaactatttttcatggcttgacataaaataaatgtgcatttgggcaaatactgcatttcagtgaggcatgtacttccattgtgtgttgaaatgtaagttggcataaaagaaccaacaaaaaagtcattacagttttattatttgttgacagcaagagagaaagaaatattctctcaagatgaacaataatgtcctgttaactgacttaaaaagagcaaagtttaaattgcttattcagagaactctaccttctaatactttgagcttcctggaaaaagaaatgggttcttgataagttatgtgaattgtgcttcgacataaatgtcaatgtttgatcacaagttttttttaccaaatgccaatctgcgaggtcagctagttcaatgagtcattttgcttaataaggaaatttaagtagttgtttctatcctttgttgtcacgttggaaatgcttcaaagagaagctacttgttctgataaaatagaataatatgaactttggaactagacaaaactgaattgagttttgcctttgtcactaaattaactgtgtggtgttgatatgtccttaaaacccttgaagcttttacttcccaatctataaaatagggatgataataccttcttggtagaatgggttttgagatgacttatctactatgtttgttatcccctgccacttggtaataataatggctagcatttattgagtgtttaccatgtttcaggaaacttgtaagcactttgtaagtattaccatatttaattctcatgacaatcttgctgtcatttgaatatttgtcctcctaaaaacttattttgaaatttcatcctgaaggtggaagtattgagagatggggccttaaaaaggttaatgggtcatgagaactctatctcatgaatgaatcaatccattcttgaattaatggattaatgaattactaggttagtagattaatgagttatctcaggagtgacactggtgacttgaaagagagacctgagctagcaagctcagccccctccccacatgatgccttgtcccaccttggaactctgcagaaactccacaccagcaagacggccctcaccagatgcaacccctcaaccttctcagactctgtaactgtaagaaataaattccttgtctttgtaaatttctcagtttcaggtattccattacaaacaacagaaaacagactaagacacgccctacaggtggatataatcattattctcattttgtaaatgaagaaacagaaacaatgacaacttatgtaattggccaagtgaaatactactaatcattaaggccagcatttaagctctcatggtgttttgctctagtgaccctatttgtgacactacattattctttaccttggtggatactcagtaactggttgccatttttattgaccatggtagtataaagcatcaagtttagcacctagctaggaatccaggtgttttcttggttctctcacttacccaggataatcaggtcttcagcaaatcatgtctattgtacctcctaatccctcttcttctaattcactttttccttgctgcctttaatctaagccaccattctttctctcttccaggctagggcagaagcctcccagtaggcccctccttagctccttgagttcttctcctctctcatccagagtgcagccagaaggatcctttacaaaaagaagtgtgtgtgtgtgtgtgtgtgtgtgtgtgtgcatgtgtgtatgtgtgtgtgtgtgtcccacctaacttaagagtttgggggaatgcccccatttcttatagcttttaggaaaaaaacaaggatccccatcatcgcgttcaaggtcctacactgaggtgacatagctagtatattcagctaactctgaaaggtcctttattcacttccttagcaatattaaacaaacccttggacacattaaatccctgttcccagcttttgcaaatgccatccccactgcctggaatgttcttcctcttttccattcacctgggtaagtttcacttttccttcattttagcttaaacctcactcctttggaaaagccttactgtaattccaatcatacgtgtgtgtgtatatatgtatatgtatatatatatatatatatatgtgtgtgtgtgtctgtgtgtgtgtcggtgtgtgcatgttatatgatttggccgtgtccccactcaaatctcattttaaattcccacctgttgtgggagagacccagtgggaggtaattgaatcatgggggcagatctttcctgtgttgttcttgtgatagtgaataagtcttgcgagatctggtggctttaaaaatggaattttccctgcacaagctgtcttctcttgtctgccaccatatgagatgtgcctttcaccttccaccatgattgtgaggcctccccagccacatggaactgtaaatccaataaacctctttcttttgtaaattgcccaatctcggttatgtctttatcagcagtgtgaaaatggactaatgcagtaaactggtaccagtagagtagggtgttgctgaaaagatacctgaaaatttggaagtgactttgtaactgggttacaggcagaggttggaacagtttagagagctcataagaagacagggaaatgtgggaaagttttgaacttcctagagacttgttgaatgactttgacaaaaatgctgatagtgatatgaacaataaggtccaggctgtggtggtctcaaatagagaggaggaacttgttgggaactggagcaaaggtgactcttgttatgttttaggaaagagactggcagtattttgtccctgccctagagatctgtgggactttgaacttgagagagatgatttagggtatctggtggaagaaatttctaagcagcaaaacattcaagaggtgacttgggtactcttaaatgcattcagtttcagaagggaaatggaacataaaatttggaaaatttgcagcctaacagtgcagtagaagagaaaattccattttctgaggagaaattcaagctggctgcagaaatttgcataagtaatgaggagctgaatgttaatcaccaagacaatggggaaaatgtctccagggcatgtcagagacctttgtggcagtccctcccatcacaggcctggaggcacaggaggaaaaaatggtttaatgggccacaccaagggtcaccatgctgtgtgcagcctagggacttggtgccctacatcccagccactccagctgtggctgaaaggggccaacgcagagcttgggccatggcctcagagggtgcaaacctcaagccttggcagcttccacatggtgttgagccttgtgagtgcacagaagtcaagaactgaggtttgggaacctccaactagatttcagaagatgtatagaaatgtctggatgctcaggcagaagtttgctttaggggtggggtcctcacagagaacctctcctagggcagtgcattgggcagtgtggggtgggagcccccacacagagtccctactggagtactgcctagtggagctgtgagaagaggatcactatcctccagaccccagaatggtagatccactgacagcttgtaccatgtgcctggaaaatctgcagacactcaatgccagcctgtgaaggcagccgggagggaggctgtaccctgcaaagccacaggggtggagctaccccagactatgggaacccacctctagcatcagtgttacctggatgtgacatatggagtcaaaggagatcattttggagttttaagatttgactgccctgctggatttcagacttgcatgggccctgtaacccctttgttttggccaatttctcccatttggatcagccatatttacctaatgcctgtacccccattgtatctaggaaataactaacttgcttttgattttacaggctcataggcagaagggacttgccttgtctcagttgagactttggactgtggacttttgggttaatgcggaaatgagttaagactttgggggagtgtagggaaggcatgattggttttgaaatgtgaggacatgagaattgggaagggccaggggcagagtgatatggtttgtctctgtgtccccacccaaatctcatcttaaatttccatatgttgtgggagggacctggtgggaggtaattgaatcatgggggcgggtctttcctatgctgttctcgtgatagggaataagtcttaggagatctgatggctttaaaaatgggagtttccctgcacaagctctcttctcttgtctgtcaccgtgtgagatgtgcctttcaccttccaccatgattgtgaggcctccccaccaacatggaactgtaagttcaataaacccctttcttttgtaaattgcccagtctcgggtatgtctttatcaagtgttaaagtggactaatacagcatgctaatatgtgtgtgtgtgcatgcctacacttgtgtgttttaaataaataaaggtcctccaataatggtaagtagtaatgatactggtaatatgaatggtagtctgtcagtagtaatgaagcctttgttcgggaaatatgacttttgaaatgtagaattcatgtcagtcattggaatagactagtacctttgacgtgcagaagccaatctgattgctaaggtgaagctcatagcctagacttggttcagggggactccctcctgctattaaggttagaaccagggtagaagttggctgctgcttcaaagggctggaaactctgaatacctacttaagtacaatagcccactcctctgataagctgtgattggtttgcttttttctccctccagcacatgattttgattttactcctttcagctttagagctgccttaaagattaatttaatctaatttcatattggttataattctggagtttgtaggtaggagagtacaatgaggtttttaagatggcccctgggatgttcttgggcggagaactagtagtagcaggattagtgacaaaaggcaataggtttttgtttgtttgttggttggttaattttttttctgtttgtttactaaaatgcagatttcaccaaagcaagaatatccggaatagtcaggatgtgcttagtcagttacctctgtgggcggatgctccccttgctcttttttcctttccttttattggtaacttgtaatcagctgctactttagtttaatgagaaaaataacagtttacattacatctagattaaagaaactgctagacgaacaggggtgggcaagttgtcaatggcatctaataaatagtagtaagtaattagcacaggtctgatggatttgaaggaaagtaaaaaactagggaagaggaattgtggattggggaaacatagctgtaatttgagaataacacatcaagaaaataagaatgaagcactgaagtcagagatctgtggggactgtgttggggagagggttgggggcatctcgtctgaggaacaaatagagtagaggaacatctcatgctgggtttgtactctgctcaccctgctccactccacctctcaggcttttggttttatcagattgtgtctataacaaagccagataaaagtgacaaagaagtgcagttcaaggttctgctgtccttcccttgtctctgggagttagcaagtcacctttaaatgagaaaacagtgtgaccttacgtacttcacacggccattctgagacaaagttggagaagtgtcatgcatcactgcactcttctaaggggtggaaggaatcaagcatattccagacctaggagggatttcttaggaattcacactgatgtaatttcaaaactcccaagacagccaccacttgtctggcattagctaacctatgacacttcactcaattgcattttgagctcctgacttagttcattcagtaacgtttttgccccaggatgccaaagcaaacactggtcctgaactttgcctcttgaactacattcttcaccatgatgcccttccaaattccctatagatgttttcactactggtgtgtacaggaaggaagttcactttgactaataaccaactctgttatttctagtggagtgatcatttgtctcttctgtccattggcctccctttgattcaagcagtggggtgtgtagaggaagctctgcatccacttgacaagccttttaggtcccaacagcagtggactccttatcagggctactcataaaaggctaaccttccaaaggaaacttgtcagggctcagctgttggcaagatggattaacaagtgcttccagctaatggagtagacattggtgacttaatgagggtagtttgaaatcttagctgtattctcttattctttttttttttttttttgaggatgataaatgagtttagttctttcttagctaagaaatgccaatgatttatttttattattcttatttttattttttattttttagagatatggggccagggtcgggggcagggaaggaagggaagtctcactaggttggccagaatggtctcaaactcctggcctcaaacaatcttttcacctggtccttccaaagtgctgggattacaggtgtgagccaccttgccctgcagaaataccaattattaaaaactcagaggttgtagtgcaacatatttgggagtggtcacaccccatggcctttgattttagtctgaagattgaaaataacctttggattttaccttgacaaggaagttgttcctcagtggacacagacatcatagttggcatagaaacagctgttgggttattcctgggccattgaagacatggcacctggcccagtctgaatggttgttctctcctggttgcttgtttaaataaaggttaagcaaaaattcttttttggttttgatttcaggaagaaataagggagtgactgcaatgttatctgaaaatgagcatttcctgtttcctcaggcatttctttatgacccccattaaagttaatgaataaccaagtgtctgacacagttgagcgtaatatgcctcacctaaggttcccggtggctgcacatttttgtgggaaatgaccttcagttcctgcagatccattattaggcaatctcttagttatagactttatcttcccaaaacattcaaatcacatattagccaaatcacttagataccgtcctaagtgctggaactctttaagtcttgttagcagaaaaggctaaagtttaggtaaataagcagatctgttccacaaatgattcctcaccttaggtatttatgaaaaagctctgataaacttttgaaagcagaaaaagacgttaaaaaatcttactgtgagcctgaaaacataaacataaatcagctaaaagataatttgccttaataggtagtgggcgatgggggaggagagtgatcagggctcaccctggcaaaattgtctctgccggatgtttcaggttcgccttctctccccgtcacctcctcagaatcttaggagaccacataggatcaatccttgttcaaaggcaaaggcaaaaaaagtatgactgcaaatatgtgaagtacgatttggcacggagttcattttgggaccctaagtcctctaggcggtacagctatatattgcaatggactgagtgtttgacacacttgcccagaactcctgcatacaaatgaggagtggcatccttaacctcaggcagttaaatgttccattcccctgaaactaccattttccaaagagctttggaattgtcttagggcctatttaaatgccataggaaaaaagttaatttcatttctttttatggtcccatgtcatttttaacccctagtagtagcagtatttctagctgttaaaagtaagtatttttgagtcacaaatctaacaattgatttgtggcaatttgtttaacctcctagagccacagcttacttatttctggaatggtatgatagtaaaatctaccttatggggcctctctgaggattatggataaagcggttaacacaattccaggcaactagtaagcattcaaaatgtgttactattattactgggattgttgccgccgttgttattaaacaacttgttcacataccttttttcactcgacttggctcagaattctaccagactgttcagaaaaatcaagtgtgtgtttaatgtacagtattttaaagtcacaaatccagaggcttttaagaataagttacaaggtctgaagtgatttttgaaagtacactgagcggagtagatcctgttgaatatattccaggctctaaaatgactatttctaaaggagatgatgctgtggaatatgttataaaggaacaaaaaattactttactctgtagacacatttcatagtttttgtgcaattttctagtttcaacagcttgtccaatatgtattgaatatatattctatgaatgatatgtgctagattctccttgggatgccatgttatagaggtcttcagaacgctttcattaagattcattcatatgtcaggacttaagatatatatatatataagaaatctcatgaacagaagtttcagaaatcagttcattgcttgcctgaattcaaggagaaagaagtcttcagagtgaagctctggatctaggagagaattttctcctcagcctgttttcaggaagtggcttctgtgtcctctgtgcttggaaattggacgattttggttaatgtggaagatcttaatgaatactttctaagagtaaggctatatacaggtcaggcacggtggctcatgcctgtaatcccagcactttgggaggtcgaggcgggcagatcacctgaggtcaggagttcgagatgagcctgggcaacatggcgaaatcccgtctctacaaaaaatacaaaaactagcagggcgaggtggcgtacacctataatttcaactactcgggaggttgaggcagaagaattgcttttacctgggaggcagaggctacagtgagtagagattgtgccactgtactccagccagagaatgagactctgtcaaaaaaaaaaaaaaaaaaaggctttataaatatcaatatcaagtccatccctccttgccctgtgtttatggggaacagtagcaacatggccaaagtcttgcccaaggcgaggtttaaattttgcagaggcatttgactctcttacagattgtcttcaagaaacaggaaggaagggtttcttcagaaactcctggaggaatctatgtttttaagtgacattgatgcttcatatgtttgcctctgaagatataacttgttttattggagactgaaactacctatttgctatatctgagaggttactcatcagtacccacatctggcattcgcactgaccattctttgtacaagagcttggttttaaaggccataaatctgatatctacactagattgaaaactatctaataaagctccttctcaagcataatttactacggtgggatgctgatgaaacagaaggatttacatatgagttttatttttaaaaatttatttgtaacatcaatgtccggaatttctgcagacatttaaaattattgtttaatatttaaattatttattctaaaaatatactttcacatggggtatataaataataaagacttagattaaaagaagaaacacaggtaagattatgtttataaaaataaaaacaatgtttatgtaagtaattaattaaaaagtattctgtgaatacaaagcagtatcaagatgtgtgtgtttgaattatatggttttttttaaaaagtatgttaccatatagcgacatatagaattttagcttttttggaaacaatcccaattatttcatatattacttttctggatgaagggatggtatggaataatggaataatcagtggatattcctgataatgttttaaaaatagagaaatatcctgggtgaagaaaacttcctttggtgttgatttggatctgattaatgattttgataccagtgggctagggaagatccccaaatgccagtgaaaccttggcctcagctgctgtccaggctcttgacaccgtcctgagaatgaattcaaggatgagttggaaaatagtggaagtacacagatttattacaaagcaaaaagtacgcattcaagaaagggcagtgcaggcagattcaagaaaagggagtggaggcagactcaagagagagtcaggtgcaagggggttgggactgctacctttatgggattctgtaaccaaggggtagaagattcatgaagattcctggaacaaggtggagatttcttggaactctggtaccacccatttttgcactaaatatggatgtttctagaactgtcatagcgctggtgggtgtgtaatttaagatgttaatgagcatataataaggtcctaggtgaaatctaggtcaaatccagtgctatgttgggtccggtccgttttaggtcggtcatagcttggtccacacccagattttttcaggatcttatctacccctagcttctgcagctatttcaaccgtttctttttgctagtcatgtgaaactgctgcctggaattttctatgttcctacaatcaccctgtattattcctatgtcaattttaaaaggaattatttgtctctggggatcttcatgagctgtggtttctctggggatcttgatgagctgtggttacatagctctaaaatggtcctgaggatgggtcagtttttacaagtagccggcagcttaaatggggtaggcagttacactggtcatttcactgaatacatcagctggcctggcatttcacttgaggtcaccaattctgagccccagagaggagccagctgttcacatttccaaaacccctatgtcaacgaatgggttttggaaatgtgatcagcctcatatttaatatcgggagatacacaatagataaaaaatgttgcctttggaaggatgtgacttgaataatgctgcaaaaggtggaacacaatttgagtgagttaagaagcccagggtagttattttggaagttgcagatttgctagcctgctatgttgagatatctctgaagacaggggctcaactccaccaggacctgaggtctttgcttaaataaccccacataaggcccttgtttcttccaaggaccaagagaactgagagctctgtttcctttttttttttctttttcttttttttttttttttgagatggagtctcgctctgccgcccaggctggagtgcaatggcgcgatctcgactcactgaaacctctgcctctcaggttgaagcaattctcctgcctcagcctcccaagtagcagggactacaggcactcaccaccactcccggataatttttgtatttttagtagaggcggggtttcaccatattggccaggctggtcttgaactactgaccttgtgatctgcccacctcggcctcccaaagtgctgggattacaggtgtgagccaccacgcccggctgagaactatgtttcttaaacttaatctgcaacatgactttaatattctaaatctctaattagtagccttgggctgggggaaggccccctgaaagttattgataagaaaagttatgatatattactcacatgcattatttttgctccaggaagataaagatcaagaaggggcagaattctgtgtctttctgtgagactgtctctttttcaacatttatttagtttccatgtgaaactccttacactgttgtaaactagtttcttgccctgtacacagcttgctgggcctgctgctgttcttgatggcctagtaggaaaggaaatggcttgagacactttccacctttcctaatccttcttaagccttgaatgatgtcagtgcaaacaccaagtgaaaaaaaaaatctcacgttgccccatttcccaactgtttgaccactgcctgttcatggacagtgaacccactcataccataacaactttgcatcattttttttttaaagaattgactacacatcaaacacaaatgcctaggtcttgggtagattccaacaaaacattacagtgagaaaaataagaaaaaatatgttacagtgagcaaagccctcagcctctgcactgaatatccttagcccttcattttcatcagattttcttgaatcacagacctaaggaatttattttctctactttgcaaaggagctaactgaggctgtaaaagacaatgctcccaatgactctgacttcaagagacaagactatgataaggaccaagttactttatttccagccttcaatttgatttattgtttttatttatgcactgcctacttcaaaaagtgatttgagggagactacagatcaaattccctttcaaaatagatctcacttctttgggggaagatgaaagggtaagggtgaagcaaggtgacacattttagttgacaatctctagacttgggctgtcatagactagagttggattcagttatctaatttgcaccgccttaattaatgctccaggtctacaggtacatagtgtgaatttaaaagtttgaaatattcagatcaaaatggttataactgtaaccattcacctatcatccatccatccaactctccatccatccatccatccatccaaaagacatttattgatctcctactcagtattaagcacttgtcatattgagtgggtggtgggaggagaggatagagtcaggtgttaacgcatatatgtacacataactacaaattatagtaagagctgtgttaaatatggcaaccattttttaagtctagaatttatttgaggctatgcagtagagaaaataactcatttatttctgggtaagtagtttaaggatcacttttccaaagtgaagtcttttcttaaaaatagaaatttctcatctacaacattcatcatagaaagaatgcagcattgcatcagaactgatgttcttgctcataaaataaacaaaacacaatggtgtctctatctgtagaatgtaggtgttgtaacacatctgcctagaagctagttaaaatgcatgttgttcttatatttcaattagaagtaagcagacttgattgtctaacacaaaaactcagttgctttgatgtatttgtttttgcatatggttcaaattatcatcaaaactgtattatcagtgataatatactaatgcagtaggttgacattaggggctgactagctgactgttgccatatataattaatccaaagtaatgtgatatggcctttaagatgtaaaagaatttacacaaattattttctcccattatttccagagattagatgttatggaaaagacttttaaaagatgacatgatttaatagccttttcctaagtagactataatacctgtaatgcagaagaatttagaacttttagacatgcatctagtttacacatttaaaagctaaatgtatatcgtatattgtgaagttcctttctttgaaatttttttaaaaatcagatttgaaaagcctttttgcctatgatgttttagagataatactgctggaaagcaagaacctgacataaaagtccataacgatagctttctaggctctaatcctgtgattccactagaaatatcttttgggtgggcatgacattaaccatcctgtcttacaaatacaatagaatatttaatgatcttccattgtattctggaaaatagactgcattctctttctctatctgcctccctctttctcccttctcttgtcctttctggtactttgccagaaaccgcctgtttctttcctggagtccagtaattgaaggtaattttttggaagatggtttcaattatctaaagccagtggaatgtttaactgccccttgctattcgtgaacttgtttacagtgggatttcagatgaattcagattacatgcaaccagatgttatctgctatggttacttttttttttttttggtgaaggaaaattgtatgagggaggggtctttgatatcatatttagatcaactgccctcaaattcttggaagtgtgcccctgggataaagttttggggtaaacttttgatcccaaccaatgaacatccaaatatgagaatatacattctctgtgtaataaatttaagatcttcccattttctgtgtgtctttatatgatactaatccaaaaaaattgcctcacaaaaatattttgtcatccatctaagttagagataaaacaattataaactgaaagctcattctattcttactctgcctaaacatcacagatttactgtcatgctgcccagataatagaaaataaatgttgtgatatttaacaagaaaaaaaatctgaagtaataaaagtcacctgtgaaacaacaactaaatgctctagtctgtagacagttgaagactaatttccttaactgacagctgaagtgaaggcttagtaagatgtattatttgtaaaggttgaactttaaaatctgaaagagaagttgaatacacaaatcttagcttagaaaacagatagatataatcaatctttatgaaataattatttgccttatttaggaatccagcatacacttaagagattttttttaaagttggtttgcaatgtaattaaaatatgatttaattttcaaagtttaattgcacacaaacttttagaaaaatgaaactatctcttgttgaatcttcaagaaggcatcaggcatgattttgctcccctataggttggagaagacatccaagagttttaggattaagagaatacaaatgcctttacatacacagacatgcctacatgcatgcatatgtgtgtacacatacatgtacaggatagatatgtacatacatacatataatattttttcttagcacttagttatatagcacttgccatattacctgaatgtagtttacacttcattgaataaaaaaaaagaacaaataaaacaattcaagattttctgcaagcagaaaagggatgcccaacaggagctgtgggcttcaagggatgtaaccactatcaaaatcacgctctggaaggaaagagtgtgttaggaaggaaaaacgttcttgatctctcttcccaccacctgttctcccggggcctcttgttgcactcacctaacaggaaggcagatggcacgggagcaggttgaagagtaggggatcaacctccccagtcaaaaagcagagcagagctgactggagaggttcacttgaagctaggagtttgaaaccagcctgggcaacaaagtgagatcccatccccaccaaaaaatatataataaataaaaaggaaatagaaaaaaagcagagtagagaaatacgaaaatgaatatggaggaacagagaaacaccagcacaccaatatctctcactgatctatgtactactgttcttatgatttgaacttcatgcaaaaatgccactgtttcaattatttttctactagtgtagattatagtctttccagtcaatgaatgtagtaattactaatccacataatgttccattatgacttagatttggttgatctggctgtgcatggtggctcatgcctgtaattccagcactttgggaggccaaggaaggaggattacttgagcccaggagtttgagagaagcctaggcaacacagtgagactttgtctctaaaaaaagaaaaaaaagtaacaacaaatttagttgtttttttcaaatgagaattttaattatgaaccaaatatataatggaaatacaaaactacatcataatatttacctgatttattttaatatatactatatatatggccttttagtaaccaactgtgtacacaaaatgcatttgataatgcagtgtcaagttgcagaatcattttagagataagatatggaatattaaatatcatttttgtgttttacctattgtgtgttttattttacttgaaaataaaacttgtagagagatgggattagttacttggtaaattataagaagaaatacagtttcctcaaataattttacatatgaaaaattagacgtaagatgaatacttaattgacaaaagaagtaagtctaaatagccatatgggtcaggtgcggtggctcacacctgtaatccccacactttgggaggctgaggcaggaagattgcttgcaccaaggagttcaagcccagcctaggcagcgaagtgagaccctgcctctaccaaaaaaaataaaataaaattaataaataattaataaaatgaaacaatcatatgtaatgctcattaaatttcaaggggctaaatttatatgcacataatacatgaaaaattcatatacagtgtcatacgctgtcagtggaattaagctaaatattgacaaaacgttaaattaaaaataccaaaatggtaagaaattcagaaatgacttaaatacctatggatttaaaaataccataatggacattataaagtattttgaaaatgaatgataaaaatattacgtatcgaaacctatgggatgcagttaaagatgtactcagagggaaatgtatgccttaaatgcatgtataagaaactagagaaggctgaaaatccatgatctaaactttcagttgaagaagctagaaaaaactacagcgaaagtaaaacaaaggtaataaaggtaagataaaaatttctgcgctggaaaacaaacacataatagagaaattcaatactgctgatctttagattcagtgcaataaagattccaacaactgtgtttgtgtgtgtgtgtgtctgtgtaaggtaccaaggaattttaaaagtaatatggaaaatgaaggggccaagaattgtgaagacagcttgaagttgcacacatctgatagacttgtactactaaatatcaacatctattataagtagggggtctcacgggccagtgtgctctgcacatggctgctagccttggctgtgtggcttttcacatcaagggaatgggaacttccggaggtcagccaactctgcaaataaccagtactcagatccactgaagcctacctccaggaatctgttacatctgagaccaggaaggagctgtgaacattaacgttgataaagaaaagcccattgaagagtcttccagagaggggaggcagagcgagatggctgaatagaaccctccagcaatcatcttcctcctctacccttgcaggaacacaaaactgaacaaatatcaacccaagaaagcaccttcatgagaaccgaaaattaggtgagtgatcacagtacttggttttaacatcatatcaagggaagagacactgaaaagggtaggaaagacagccaacaccaccccttcctcatcccccagcagcagtgggctgcttggcgcagagagataatttgtgcttgggaaaaggagagtgcagtgattgtaggactttacattgcaactcagtgctgccctgtcacagcagaaagcaacacagggcagaattcagccagtgcccatggagggagcgtttagatcagccctggccaaaggggaaccgtccacaccagcaggcgggtttgagctagctccaccactactggctgaagtgctccattgtagtccttgtggcctagactgcctttcagataaatttgaaataaatttgcctttcaaaaaaatttgaaaggcaatctaggctacaaggactacaattcctgggcaagccctggtgctgtgctgagctcacagccagtggacttgggtgcacatgacctagtgagacacaagctgaggcagccaaaggaatgcttgtgtcactcatcctccaacctcaggcagtgcagctcacagcactgggaaagactcctttcccttgtggaaaggagaaggaaaaggagtggggagaataaagaggactttgttttacaacgtggataccagctcagtaccacagtaaaataaagcaccaggcagagtcctgaggcccccattctgggccctagctcccagatgacacttctagatctaccctgggccagaagggaacccactgccttgaaggggaagtatctagtcttggcaagattcattacctgttgaccaaagagtccttgggccttaataaacatcagtggtagccaggtagtactctccacaggcctcgggtgagacccagttctgtgctggcttcaggtgtgactcactgcattcccagctatggtggctgagagagattccttctgcttaaggaaaggagagggaaggttaagaaggactttgtcttgcaacttgggtaccagctcagccacagtaaaataaagcatgatgtagattcctaaagttcccaaattcatgcccttgcttcttgacagcatttctagacccacctgggtcagaagggaacctgccaccctgaagggaaagacagaagcctggctggattcaccacttgctaactaaggagcccttgggccttgaatcagcagtagccaggcaatagtcaccatgggccctgggcaagtcccagtactgtgctggcctcgggtctcacccagcatagtcccagtgacggcagctataggggtatttgtgtcatcctccatcccaattccaggcagttcagcatggagagagagactccatttatttggcagagagtaaggggagagaacaagagactgctggtaatctagggaattcttctggctgttacccaagactaccaagatggcacctctatgagtcatcaaaaatcatagcatcactaggcttggaatgcctcctaatgcagttacagctgcagtgaccaaagattagatcacaacattcatttccctttgaatgcttggaaagccttctcagaaaggtcgggtacaaataagcccaaactgcagaggttacaataaatacctaactatttaatattcagtgctcagacattgacaaacagacacaagcaccatggtcatccaggaaaacataacctcaccatatgcactaaataaggcaccagtgaccaatactggagtgacagtgatatgtgacctttcagatggagaattcaaaatagctgttttgaagaagctcagtgaaattcaagctaacacagagaaggaattcagaatcatatcagataaatttaacaatgaaatggacataatttttgaaaatcaagtagaaattctggagtggaaaaattcaaccaatataccaaagaattcaccagagtctctcaacagcagaactgatcaagcaaaagaaagaattagtgaacttgaagacagggtatttgaaaatacacagtcacaggagacaaaaggaaaaaagaataaaaaagaatgaagcacacctataggatcgagaaaatagtttcaaatgggaaaatctaagagttattggccttaaagaaaaggtagagagtaagattggggtagaaagtttatttaaagggataataacagagaactttccatgcctagagaaagatatcaacgtgcaagtacaagaaggttatagaacgccaagcaactttaacccaaagaagactacatcaaggcatttaatagtcaaactcccaaaggtcaaggttaaagaaagggttctaaaagcagcaggagaaaagaaacaactaacatacaatggagctccaatatgtctggcagcagacttctcaatggcagccttacaggccaggagagagtggcatggcatatttaaagtgctgaaggcaaaaagcttttatcctagaatagtaagtatctccagtgaaaatatccttcaaacatgaaggagaaataaagactttcccaaacaaacaaaagctgagggatttcatcaacagcagacctgtcctacaagaaatgctaagggaactcttcagcctgagataaaaggacattaataagcaataggaaatcatctgaaggcacaaaactcattgggagtagtaagtacacagacaaatgcagaatagtataacactcattgtggtgtgtaatggtgtgtaaactactcatcttcagtaggaagactcaaagctgaacctatcaaaagtaataacaagaacaacttttcaagacactgacagtataatatgtgaacatataggccaggtgccatgactcacacctgtaatcccagcactttgggaggctgatgtaggatgatggcttcagcgtaggagtttgagactagccagactctgtgtctacaaaaaaataaagaaattagccaggcatggtggcccatgcctgtggtcccagctactcaggagactgaggtgaaaggatcgcttgagcccaggaagttgaggctgcagtgagccactgctccccaacctgggtggcagaccaagactctatctcaaaaaaagaaagaggaaaagatatacatagaaacaacaaaaagttaaaaagcaggagaatgaagttaaaatgtagagtttttattagttttctttttgcctttttgtttttgcaatcagtgttaagttgtcatcaatctaaaataatggcttatttgcaagcctcatggtaacctcagattaaatgttaaaacacaaaatagcaatgcaaaggcatgaacaaaattttgtatgcaatatgggtaggtttcaaaagtataatcttgaatgatgaaaagttgcagaataatgcattcagtatgatacaatttaaagatataaaagcaatactgtatattgttcagggctatatatctgtacaaactttaagcaattggctgaagggatgcatactaaattcatcattgcagttactcttggaaagtggaatttgactgggaaccaagaggacttaattttatctgtaatggtttctttcagatgaaaaaataaaaggcttaaagccttgaagggcaaatatcaactgaattcatgatgatgattgggatagaagaatacttttctacattaaattttttttattttcctcagaaagcaaaacaaaacacaaacaaacaaataaaatctattatgaatgattgggactgggtataaatgaggtgtttggaattctggtgatgttctataacttcatcaagaggtagaaacggccgggcgcggtggctcacgcctgtagtcccagcactttgggaggccgaggcgggtggatcatgaggtcaggagatcgagaccatcctggctaacacggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaagaggtagaaacatggaaatgttcattttgtgaaagttcatccagccatacaaggtaggattggtccactttgttgtatgtgtgttatccttaggtggaaatttctggagcaaatatggcaaaataagaaaatttgacgtagtctgacataaaacttgacatacacagattattctttatgcttttctaaaagcttgtgatattttaataacttcaaaagagatggttcattaataaaaatattttgattttggctgtattttgattgcaaatctgtgtactgcaaaacaatctcattacttgctttttctgtaccataccatgattttcacttcatcacaccttagcaaaagctgttggggaatgagaagacatgaatggtctggtaaatgctgttgattatgaaatcctctgtacctatgatctcaagaataatggtggggttctggacggagaaggttagaatgatagcaggtaggaagtctcaacagtaatagaaaatggctgtttgggaaatgcaaggacccagaaccctcctagtactgcagctgtcggtgagtaaatgttcatttgataagctaccagatcacctctcaaagtgattttgtccaagggcagtccactcaacactcaattacgcagggactgagtatacaggacttcaattttctccttccttttgagaaccactatccaaaggataaaagaaaagtagcacagcactctgctctgtcatgattattgtttacctttggctaagaggtgtcatctctccagctttcctctaaaactttagggtctaatggtcaaatcccaggaccaaactccaggtgtttaactgttgcatttaaaatgtatttataacatattattattattattttgtcattggtttgcaagtacgctgcaatatgctatgtccattttccgtttgactaaatcaatttgaaaacaaaagtttaaaaatctaaactgtgggttttctagggggatttatgttttaaggagtgataatgaggtctagaacatgttatcttattttttgtttttttttaatttttatttctgtaggttttttgggaactggtgctatttggttacatgagtaagttctttagtggtgattggtgagattttggtgcacccatcacccaagcagtatacactcaacacaatttgtagtgttttatccctcactccctctcatcctttcccccaagtccccactgtccattgtatcattcttatgcctttgcatcctcatagcttagcgcgtgtgcatgcccacacacacacacacacacacacacacatatacacacacacactacaattcctttatccactagttgattgattggcattcgggctggtttcatatttttgcaattgtgaattgtgctgctataaacatgcatgcacaactatctttttcatataatgacttcttgtcctctgggtaaatacccagtagtgggattactggatcaaatggtagatctacttttagttctttaaggaatctctgtactgtttgccgtagtggttgtaatagtttacattcccaccagcagtgtagacatgttcctttttcaccatatccacacaaacatctagtatttttttgttttttttggctatggccattcttttaggagtagggtggtatcacattgtggctttgatttgcatttccctgatcattcatgatgttgagcatttttcatatcttttttggccatttgtatcttcttttgagaattgtctattcatgtccttagcccacttttcgatgggattgtttgtttttttcttgtagaacatgttcccttattgattggttttcacattcttatgatcaatgacgatatcattatcaccaagaatttgcttaatacttggtgcctacccagcctgatattaaacacagggtggggaaaaagttagttttaatgtaggtgcagactcaaattcctatggggaccggtgaggtaacctaaatgagcaaaatggtcagggtgtaagaaaaaagccaagaaaccgccatgataaatggaactgtatttgcctcagtgccctgaagacaattgggagtagtgttaaaccggaaacttctgaatcagacacgctccactctacttccagctgattgtagccatacaggaatttgggcccactattgtcaaatcttgatttttcaagagaaacatggaatatctctcttttaaaaaatatgaaatttttccattttggaaccaatccaattagaaagtaacaaacacacattttacagcatgtgtctgtacagtgtgtgttacttcctaattggattaattttgttactttctaatttgattggttttgctaacagtaattttctattactgttgagagttcttacttgccatcaatctaaacctctctgtccagaacccaccattattattgagatcataggtacagaggatttcataattaacagcatttatcagaccattcatgtcttccatatgggccaaacaaaatgcttctaagggctgtttttggcataatcctatgaacctcagctttccaatgtagtcaggggaaataagacacacaatttatgtaaaaaggatatgaaacaacagtaagtgctgcatgcattcctctttttattcattcaaacaatagcatttattaagggccttctagcttccttgccctgtgtgagttactagggttacaaaaatgaacaaaattattttgtattgtcaagcagcccggtctgggaaaagaaacatatcattagatttgttattaaacagatcataagagtctaataataattgggacaattagtatggtagaatttcaaagtatagagacttttgaaactgtctttgcataaattatatcattgagaaaaattatatccaacagtaagctgagctaacccactccctatcttgcctttcccttaattattcctgggcttttgggccaagctaactttggaagacatttgggctatagtttaaatgataataggccttgcccccaaactcaaacacttttataaagctaatgtaaggctacaggctggagagaggagggaagcctgaggcctgctaaggtatagacataaatgattgtcagccactattccagaggttataaaacatgcaacttccccagttactcctgtaataacttcactattgtagaacctaagattggccttttgagatatcttttcaggtttttttgcatgtctgacacctgtggttccatctggacctgccaatctgacccctgtggccccacccagaaggtgttcagcatgtagatggacagctttgacctcctgcgagttcatctccaccccaacaaatcagcagcaagcacccattacctggccaacaccaccccttccctcaaactgccttaaaaaaggcctaaccggggagctttggacaagaatggtttgagtactaactctctcccatgtggtgtggctgtcctcatgtctattaaactctttcaactaccatgccaaggtctttctttatgcagcaggcagttacacttcgctgacatttttcttaaggtcatgggaaataattagcttctctttaaattgtataaatatatcccctctatctggactacactttagtcaggttgacagaagcagaaacaagtcataaaagtaccttacagtcaacttctaaaggaagtactgtcatagaagtgtgagatttcctaggagctgttgttattaaccaatagttttaacacccttttaaagcatatcatcaattatactaagtacacagggctatttattttaaatgggtgtactaccagatagctatctatttatcaatatgcacacaaacacatacattcatttacatagtattttatttcttttgccactaaagacattcttactttagctacaagttaaataacagcaacggccacttttttttttctcacctgcaaactgtggtgcagatggaaagaaggcacttaagtgaataagctgtttttaattctagaactctttggttgtgataaaaatggaaactatgtgctctagaaaagctgagtaaattcaaactgtttactgttaaatgcaacttatttgtcaatttaggcagtaaaggtctgaacactcaaattctgtgaatgtccttataagcattcactttgatgtgtaaaactttgtagacttgaaggagggagtgtttgatttccatatacttccaaatattcccttcaggcagtttcctccaaagttggaatattgtggcgagtaaggaggaagttaaggattgctctctgaaagttattttgtctttctaggtggaacaacaatgtattcattagtgataacaatctagatatgaatgatgtaatgaagtatcggttgaactaatgagatgggaagctacaataacctattgactattttgctaaataatatcgccaccttcaaacataaaaacaattgttgaaaaagcttctgtcaaaaataaacccttcaatattttatgacaggtattattgacagaatagaagagactggaatttcctatcactgtggttggctttaaagaatacaacttttaacacatttttcatctctgtaataatacagtaatgattaaattccccttaaaaagcccaaggcatctatttgtttcatggaaacttccaagtgtcctctgtacagacttgttcaagtgggagttcataagtgcaagaacagtaaacttcagcttatctaacatggccaaggaatggtatgttctacttaatcaaatattcttgttgttggagagctgtttcacataccacgcattttaattttcaaagagtaacctttggttagcattaaagctgcactcacatagcctatagtttgctttgatgcagtaatagaagctcatctcctttatcccccacaaggtagttcttctatctttaggtgctttccaggatttggccagaatttacccatggacccctcctattgtagttctcaaattgcgaattctgagattcactgagagtcatccaagctctcagtggatctcagaatttttgctctgcctcaaaccagcctaccaaacgtttattctttatgtgtgactggttggctgcttgtggaaccagtttgagcttcagtcttttagttgataactgtgtaaacatactaactatccttgaataatagttgattgaaagagccgattttgcctcttatgatttaattaaaataaaggatttggaatcatataatgatataaacttttgtaatatataaggactctacctgacatatcgtctctagcctaaatgctttattataaacacaatagttgcattcttgagtgactgttgtattctgtgcactatactaggtgctttacagaagttatctccaggactcattaaaaagacacaaagaatgcattttatatatatatatgtgtgtgtgtgtgtgtgtgtgtgtgtgtgtgtgtgtgtgtacgttggaatattatgcaaccttaaaaagagggaaatcctggaggatattatgctaagtgaaataagccagacaaagaaaaatagatccatgacctcactttaatgtggaattttaaaaagctgaattcatagaaacagacaatagaaaggtggttatggggttggggcaggggaacggggagatgttggtcaaagggtacaaacttgtaattataaaatgagtaggttctggagacctaatttatagcatggtgactatagttaatacattatatacttaaaatttgctaagcgagtataacaagtattcccaccacaaaaaaaggtaactatctgaggtgatgcatatgttaattagcttgattgtggtaatcatttcacaatgtatatgtatatcaaaacttcgtgctgtataccttgcatatatatattttttatttatcagttatatctacaagctgaaaaaaatacacacaaataaacaaagcaaaacaaaactgtaagataaatttaatagaagctttggaaattactgccctatgagatcatcagcagaggagcgggtcttccattcttcctgtacaatgtctgctgttgggtcactgcacactgctctcgggctggctgcctactctttagaaagtctgggtacttcactcccaccaactgagaagtgtgcttattaagatccagtttgctctcaaacctgtttatgtcaactgacattgaataatttcaacataaggtgaacaaaaagagtgtttttttaaaaatgaacataaagtctaaggctttgcaaaattttgataaaagccaattgctttaaaaaaaatactgtcaaagtaggtttgggtgagacccctgtagaggactgggggaaaccataaaaacccaggagaggccgggcgcagtggctcacttctgtaatcccagcactttgggaggctgaggcaggcggatcacaaggtcaggagatcaagaccatcctggctaacatggtgaaacctcgtctctactaaaaatacaaaaaattagctgagcatggtggcgggtgcctgtagtcccagctactggggaggctgaggcaggagaatggcgtgaacctgggagttggaggttgcggtgagccgagattgcaccactgcactccagcctgggcgacagagtgagactccatctcaaaaacaaaaacaaacaaaaaaaaaacacaaaaaagcccaggagaattctcacactgccctgtcatacattatatactctcttgttcaattttagagataatggaaattgtaataatgcatcatgagtgaggttagtacaagaatgagaacttggaactctaactggtggactatgtcactcagggttcaggtgcaggaaacagaaaccactttaggtattttaagttaaagggatttaatataggcaattaggtcctcaggatataggatttttaaaaagggcaggaggatgagactcttttctggcctgccaggaatgactcccggaacaaatactctggaactgggccaccagggttgctgccacctctttgtgatcatgacagtggaaaatcagggggcgtctacctccaacaccacatgtgccttttaacactctcagggacattgcttcaggaaaccccaataactctggggccaggcttgcccatccaaaacagccaagagtttctgtcctccattcatcttccttgtgcaggccaggggaaccctgatttgcattcagaatcctaactccaaagaaatgtaggatctggagggttttgctgttcatcctctgtagtacaggaaagcacagtagaagaggtgtgggattgaagctgagtatcaaactccctatcaaattcccctagaaaagaactggctttctttctatgaaaataagttggtgaattaacgtgctattagttctttattaaaataaaacttttgatatgtagcctattttactgaccaattataagattatttaaaatcttatagaattattaaaatgggcaggcttagtggctcacatctgtaatcccagcactttaggaggccaaggcaggaggattgctggaacccaggagtttgggaccagcttaggcaacatagggagactctgtcttatagatgctgtctccaaataaggtcacattctgagctactgaaggttaggacttccacataccttgtatttatttttattattatttttgtaacatagagtgttgcagataaggcatttcagcaggtatgttttgagcacagactgtgtgcaacactttgtgtgggatgttcatcggggagaataaggaagaggaaagcaaagatgacctgatcatggtgcaggttcttgagaaacttaaagtctactgagaaagatggatgcacacgcagataactgtattactaagcagaaataatttaagtatgaaaggctctttggcgctgagaaggactgttccccccttacataagagggagaatcaacacaaaccacagacatgtagtttacgtagtaaaatgcatgtacttaaagtggatggtatggcatgactggagccactttatctgttcatttattgcttaaaataaactatgtttattatcaccttattaaagaagtacctattacttttaaaaaggtacttcttttaaaagacgtacctattactttgcatcatggttggatggatttttttccttttctctttccttttctgtgggtttagtggaggaggagttgggaagcttgagtaaaacccttattctgccagaaaatgtagcagttatatgtaattggctgtctttactcagagaaacaggagaacctgtgaggttcagcatggtggactttgattaaacaatgattatatatgaggcagttggatcctgctccaaatgctggttgcacaacttcagacaaaaggaggtactacaggaaaaagccagcaaatgtaccccattattgcatcctggtctatttatgatgggtgtccacccaggtctctggggacagcctaggtcacactgatcttgggtctccaaacactccaccaagagtagttttaaaatatgccccttaagttgattcctccccaaagaagcctaaaacatataggattcttggcaaactctgtcatcatgacattatataagatttataaagccctcctaaagattgctgtgggattatggaagcttcttgggtgccttctggcccctctaatcaacttttcacactgttgaggagataggggaagcaaactcatcatcactccaggtgtgtatcttctcacacttgatcttctgaactcagaggacagagatctgattataagaattattctttattacccaaaatttctataaagagcatgttttgtttatctgagcaaaactatatcatgagactaattatccctcttgggtttttgttgtaattaagctacacttttccccctgatttttagaaatttagcttttgaaatagaagataaactaaagaaaactccttcccagctaatttttttccataatttttttcagtctttgaaacacagaggtctctccccacctccctatttttttttttttttttttaccactgaatacattgtttcggcttagttatggattgttttctgaaaatttatctcctgccttccaactaaatttcaacatagaagcaagtgcttttattctctcttctttcccagatatataaagtgtctagttcttgtgttattggcaagattatgtttcctttgttttcttaacctcagcttcataaaaaaagctcacttcatgcttctgctccaagattggagagctcaaacatttataactccaaaaacaacatgttgccctacagaaatttaccacttgaatttgagcagtgttgaggggtatgccatgatgataggcagcaatggcaaaagcaaaggtaaaaagaagaaaaagagttttttgaaatgtgagctttgaattatttgtcggactaaataaatagcattaccctatcttccctaccttatgcagaacctcattttagaaaatcagcaccagccaaaagtgtaatgcaccatgccgccacttaggtagttacacattatttgaagatattccttaaaatgcctgctaagccacttttatctcttctgctatagcagaggcacagagcagtagaaagcacctaaatagcttcatgttattctttacttgaagaaggaattatagtcccaagatcactatagccgtggtaggcactcctaaaacaaatgtacagttcaggtcatttaattttatggttatagataaatgcagcgagatgagaacaaataacttaaacagtgattagccttaagtctacttgtgtcaacacaagatttgaggacagaatgaatcttctatttattttctgggcatttcttaaaactatgtttgttcctattaatccatgaaatatccattagttcacatacccaccgttttttatatttgtagctcagcaacacaaagacaacaaaaatataataataacaataaaccagcaagtaaattaacttactgttgtttgttttgttttgttttgaaatgagcgtcagtgaatctagtgctatatctgccaatgtcttgcttgtatcaggagctcttagaaaaagttcacacctaagagcactatgagttggaaatgcctattttagatgtgtttctcccatgtttttcctccaaaatcactcagtgaacctggttttacttgacttattttggagtgacatcctcaaagcatgctgaggactgcaactaccaaatataaagctggaaaggagtgatgctgcctgatgctagtgacaagttgttccttgtgtggcagacagattcaaatggattaatgttcaagccaagccctttcacctctactttctcatgaggagtgacagagaagaatgtgtggcttgtccatagacctcctgactcttctgccacctttgagttgacaccactttctgatctgagacagtttgtcacttagggtcagtagttttgccattcagtgaagttgtacaatggatttcctctgtggtgggaggaagagcaggaaagagagaaggaaagagagaggaatcggggtggggtaagaaatacagagagagagagagtgagagaaggaggatctcttttactaaatgttatctttgcctttttaattggtatttttagataataataactttcctatattaatagctaaaccctgtccttattatccattcagtgtgtatgatatgctcatacctgtgaggctccgtgatgggaaatgacatagtactctttgttcccccaagttctttttgccacttttcctggccatggtctcatcaaagcatttggaaaatgtgcagctgtggtcttccaggaggggacagatattgtactcatcgagtcggtacctggtgtctccactctctcatgacttagcccttcccctctctctccatccagccatgtggtttgtgttgaattaactgtccttgctgcaggatgaggccctaatgtgtttaagctaatcactatttcctatcccttgggtcatggtgtttagctcagggttggtcatgtgtttttagcaagggagcctcagggctttttgtggcctttccaactctggcctctacctcttgttatgaatgaagatgcattgagcgccgtgtgctcttggcactcatgttatgaccagaggacaacagcatcaggcagatacagcagaagtcagagaggggagatgcaaacaaatagggtgttttggttgttccctgtagcccatgctactgctggatgtttcagttatatgtgatagtaaattccttttattaaaggctgtttgatgggtttttcttatttgtcacccaaatgaaccccaaagggtcacaaaaacctgactgaatttcaaaatactttgtcattaattcttaattggtggtgggaactaaacaaagaaaacaccaattatggcaaaccatcgtgaacagtgaaagtttgacactaacaataatacataagacctaaaagtaagaccactgaagttttgcatcaaatcagccagatttctccctttctctgaactgaagaaaaatagtctacatcatggctgtttgttttaacttaaaaagtgtgaggaagtgagcatccagccccaagctacagtaaacagctcgttcaagcaaattacctagaacaaaagaaacacctctgacataatgtgggggtccaagcctgaaaataatagggtgctcagcaaagtcccagaacccctgtaacaagagcccggtagttcttatagcattcggagccaatgggaaggagtacacttttaaaatgtggtacagttggtgctgaagtctctttacccttgatttttcttttccctcctgaataggaaagcagagctagctctgtcatattgagccagttggtaatgggctctgccaggcgtggaagagataaaagccaccacctgcctcacccacgctccccctaccccatttcccggtctccggttgtctgcacagctgctgacagccagtcattgttccaccccagggctgcctgggagctcagccgtcccagtctcagaagcacaattgcagtttgaatgcagctcctgggtgggtttcctgtgcaccttggccatgaccccttggaaggctgtatgcctgcaagttgagcagagtctgatcatacacggcttaagtacttgccatgtgccagggcctatgaagaggagaacacaaaccagcgttacagggagggaaaagggtttgagcaaaagcaagagaagaaaaagtatgtataacaacattttgggggcatctattagttttctggctgtccagggtctactcatcttacttgctgagtagaacccctctttctcctcgagtatttctcccaggcctggccagtgagagcattgcattccctcctggcaactgtgattgggtcagagatgggcaaacgacttagctcaacgaagcccctgagcctcattgcacagacctagctttgagaatgagggagattctcttctttctttctacttgagaggagaatttataaagaggaatagtcaaaagtaagcctgaaagagcattttgtggcaaatatattcttgcttcttgggcatggtagacactgtgataagcaactcagaaccaccccctactttaggaataaaggacttgttccccagcagctgggagtgaggctggtagacagtcctcagctgtcaagcccctttgaggattgcctcaactgaagagagctaccgtgcgcaaggccatgccacctttttggcataatccatatccagtgactgatcaaagtaggggtatagaggcttgacttttttgctgcagttcaggacaactctggaaggtcaacccatcttcagcgttccttctagggccaactgaaacttcccttgaggttgcattgcagctccctctgcccactcctgcttctgtcccttcccttctatggcagtgtatcccaagagccctccctaataaagctcctgcaggttaacctaccttccagggagcccaacctacaacaccaagataaattgcttgtattttttcctggcggtggagcttagtgactgaaatgaagcatgatcactctgagcagaaggatggcagtaaactgaagcatgacttaagaagatgatgcaaatcatcacatttctcctgcctgtagctcaggatccaaacaccagtgaaagccatggccatggccatgcacttctccttttaggccatatggcattcagtgtgcagttcactattcaacaaattgaccacttgttttggttttatgcaggcacaatctgaaaatcatagttctgctgttaacatcaaataccttttaatgatgtttgacatgaaaaccaccatatactcttatactttccccctggttgtctggtgtgaagcatcttttaaagaaaatttatggtagttacctttataatggtataactcttaccaagtttaaaattaaaatgttatcacaagtggcatttcccatcccatttcaaatgtagagtacggcgagaagtctcaggaaattaaaatattgcctttaaagccctccttttatggtgatgtgaaggaaattgcagcacactagcatttacccaactatcaatatttttttatagtctaaaatatttgccaacattttccccacgtgaaatctattatatgaaatgattaaaaacaaacatcacgtgcactatacgttggagatgcttttaataacttggagtcagagtaaatgatcaccagggatcagagttaatacgggttgaaaggatgcccttaaaatcatgacagtggccttgtattaagcttgtggtttacatgcttttttctgtactgaatcgctaaaataaacaggcattcttccagttaattgtgtgtgagtgtatgtgtgcattgcatagtcacacattccatattgcttctgaaacataattttatgtaaatgattgtaaaaaacagaaatctaagctacctcagtactgttatataatccgtaacagatttgccaacccaaaagcctaattctatcgttaagacctaaattcatatattttataaaatatatgatattgatgttgtccataagctttttttgatgcgatccccccttatacaaacccagtttttattgtactcttttgtaataattttgtataatgtggtctcttcaaaagcgagaccagcacctattcgtttttaagtcctactacataggaccatacggcatgttgcattgctatttgaatctttttagaatggatcaggatgtcccaaaaaatcttagaagctgtactaatctcagcagtataaatactatatacttataacactattatataaatgtttaataattcaaacttcttttacagtaatttagtttttgaacttttaatattaattttttcattctagtttttttgttttatttaacatttggcttcttcagaggaactgcaaccaaactttaaattacagatttattattcaagagtcacaaaattctatgaatataaaagaaacttatctaattgaactttcaaatcatagtttcataagtttatacataacctttatacatctaaagttattaatgcttaaaactgtactgtgacttttgagcaccccagaagtctggttgttaattttttttctacatttttaatctcctaactatgtgtgtttttttttttttggtagtacccccagcacacaattttcccagtaagtacaagcatgtaaaatacaatttccttgccagttaatgttccatacactctaattgtgaaagccactgtatttagtgacaaatttaatcttcagtacttggaagaaggcaacatgggttaagattaaaaaagaggacataattgttgagttctaggtatcttcacatttttaaaacaaatgttctggaactgatgttcacgaaacaggtcagcccctcactgaaccagttctgctgtgttgataaatttcttgttagaactatggcaggaagcaaagcaaaatgattatagaaaaacatgtgctttagcagcaagatggttatttgagcatatagttttcctcttgggtgtccttgaataggcctatgttgagttgaagggagccaagatgataaaccagacataaagagctctaagcataggtttagaaaacggaagcttcttggaaccattttctatttgacagaaacaaaccctgactcagccttctcatttttccacataagtacactgaattctcttccccatccaaggtgtggatctttctggaaaaacctctagctgaagtgtttttacgtctgcaagaattaaaggtcacagactcttgtttctagacaacaaggacagttcactttctgggtgttaatgaaaatccttctatcttgaatacttcctgagaatacttagagtattataacagtcatgaaaagaaatgatgaaaatacaatcacatgttatgggtggaggacagcagggtgcagtgtatcacttctcggtctagatgacacttcaaagtcccttctttctttctaaaactgtcccaggcttcagactgctgactctcctttcctgttctgagctgctacagtcgatcctgatatggtttggatgtttgtcccctccaaatctcatgttggaatgtgatcgcaatgttagaggtagagcctagtcggaggagtttgggacactggggcagatccctcaagatggcttggtaccctccccacagtaatgagtgggtttttgctctattccttcacacaagagttggttgtttaaaagagcctggcacgtcccccctctctctctcttgcttcctctcttgccatgtgtattagtttgttttcatgctgctgataaagacatacccaaaactgggaacgaagaaaggttgaattggacttacagttgcacatgactggggaggcctcagaataatggtgggaggcaaaacgcttgtcttacatggtagcggcaagggaaaatgaggaagaagcaaaagtggaaatccctgataaacccatcaggtcttgtgagacatattcactaccacgagaatagcacaaaaaagaccagcccccatgattcaattatctcctcctgggtccctcccacaacaagtgggaattctgggagatacaattcaagttgagattctggtggggtcacagccaaaccatatcatgctgcccttggcccctccaaatctcatgtcctcacatttcaaaaccaatcatgccttcccagcagtcctccaaagtcttagctcatttcagcattaacccaaaagtccacagtccaaagtctcatctgagacaagtcaagtcccttctgcctatgagcctgtaaaatcagaagcaaggtagttacttcctagattcaatgggggtacaggtattgggtaaatacagtcattccaaacgggagaaattggccaaaacaaaggggttacagggctcatgcaagtctgaaatccagcggggcagtcaaatcttaaagctccaaaatgatctcttttaactccatatctcacatccaggtaatgctgatgcaagaggtgggttcccaaagccttgggcagctccacccctgtggctttgcagggtacagccttcttcctggctgctttcacgggctggcattgagtgtctgtggcttttccaggttcacagtgcaagctgtcagtggatctgccattctggggtctggaggacggtggtcctcttctcacagctccactaggcggtaccccagtagggactgtgtgttggggctccaaccccacatttgccttctgcactgccctagcagaggttctccatgagggcaccacccctgcagcaaacttcttcctgggcatccaggcatttccgtacatcttctgaaatctagaaggaggttcccaaacctcaattctagacttctgtgcacctgcaggctcaacaccacatggaaactgccaaagcttggggcttccaccctctgaagccacagcccaagctttatgttggcccctttcagccatagctggagtagctgggacacagggcaccaagtccctagggtgcacacagcatggggaccctggacccagtgcatgaaatcactttttcctccttggcctctgggcctgtgatgggaggggctgctgggaagttctctgacatggcctggagacattttcctcgtggtcttgggaaataatattaggctccttactacttatgcaaatttctgcagccgccttgaatttctccccagaaaatggcttttccttttctatcgaatagtcaggctgcgacttttcccaaacttttatgctctgcttcccttataaaactgaatgcatttaatagcactcaagttacctcttgaatgctttgctgcttagaaatttctcccgccagataccttaaattatctctcaagttcaaagttccacaaacctttagggtaggggcaaaatgccgccagactctttgccaaaacataacaagagtcacctttgctctaggtcccaataagttcctcatctccacctgagatcaccttagcctgaattttattatccatattgctctcagcattttgggcaaagctattcaacaagtctctaggaagttccaaattttcccacattttcccatcttcttctgagcctccaaactgttccaacctctgcctgttatccagttccaaagatctttgagtatcttttcagcagcaccccactgtacgggtaccaatttactggattagtcaggattctcttagagggacagaattaataggatatatatatagagagacagagagagagagagagctctaagcacaggtttagaatgtgtatatcctaaagggctaggcccgtctctccttttcacgtttttctgcctgctttatattcgctggaagctgattagatggtgcacaccagattaagggtggatctgccttccccagcccactgactcaaatgttcatctcttttggcaacacccacacagacacacccaggataaatactttgtatccctcaatccaatcaagttgacactcagtattaaccatcacaccatgtgacatgcctgttcctcctttgctttctaccatgagtaaaagcttccagaggcatccctcgaagctgagcagatgctggtgtcatgcttgtacagcctgcagaatcattggccaaatttaaccttttttcttttaccaattacccagtctcaagtattctttacagcaacacaaaacagactaatacagacgccttgctaggtttgctctcctataagccatgaggtgtaatgggacttttattccagttttcccttcttcctctgaacacacacacacgcgcgcgcgcgcgcggagagagttttcttggaaagaagaaaggaagaaaacatttaattctcattaggacctaaagctttacaactacacaaagttatgagcttctattgtgtaagaacgttatatcatgtagtcattgaaataacccttttataagtcaaaaacgaagcaaaacaaaatttaaaaccccaaaatgcaaagaggatgagcagttgtttgtagtccagaagctggtgggtggcaggtttgtctaactacaaagcctttttccactacacccctgctgacccacatgagaagcagagagatggtgacaaaaaaatagagatttctgtatttaccaaagcctggaaaagttggtaccacttatggcctccttttctagactcttgactaacagacagctttccttttttaatgtccaagggtggagttctttaaaccttttcgttacttcatagtccagatcatactaactgtgtcttctagaacgtaatgatacagttagatgagggcatattactaataaaagaaaaaaatgaaggggagaagaagaaaaacagttagagaccatttgattattcttgaataggattgacaaacactttctgtaaagggccaagaataagtattttagtttttgtgtaccaagaggtaaaattgaggatattgtgtaggtactgatatagaaagagagaaagcaaatttttacgaacattttattgatgaaattaaacataataataattgaatacttaaaatattaactagtaaataagaagaaaatttattctagtaatgaaaaggatgaaatcatttttgggtgggtaacattttgcttaattgttgttcaaaattagttttccctgtcatcaagttgatcataaatacgtattgataaaaaagcattcttagcatctgggttatactgaaagagatgggaggctggatttgacctgcaggctatagtttgcctacttctgctgcaaaatctcctgtggatattcacatctcatggaatcaaggagaagccactactgtgttctcttgatttcccaagtcctcacctgaaaggtcatcttaaggaaggacttatcaaaattttttcctgggatacttctatctatactttaagaattatagataaatggcttgagacaataggagagaggagttagaagttgtctcagtgaaatttctataagatctatctgaaaaaatttatatgagttttgaaaattactctatgttgtgatcatatttgtttcctgaagcctgtgtcttaaaaccaaagtcaaaagaagattcaccatattgctaagtgaaggaagccaattttaaaaggctacatattgtctgataccaactgcagtcatgagccacttaataatagagatatgtcctgagaaatgcattgttaggcaatgtcgtcatcatgtgaacatcgtagagtgatttatgcaaacctacatggtatagcctactacacacctaggctatactggtatagtctattgctcctaggctacaaacttgtacatgttactgtactgagtagtgtaggcacatacaacacaatgttaacgatttgtgtatctaaacatgtgtaaacctagaaaacatccagcaaaaatacagtattataatcttataagacaccattgtcatatatgtagtctgatgttgacggaagtggtgtaatgtggcgcatgactctatctgacactctggaaaagggaaaactataggagactatatacacatatatatgtatacatatgtatacatatatatgtaatgtgtgtatacatatacacatgtgtgtatatgtatatgcatacacatgtgtatatgtatacacatgtgcatatacgtatatgcatacacatgtgcatatgtatacacatgtgtgtatgtgtatacacgtgtatgtgtatacacgtgtatgtgtatacacgtgtgtatacacatacgtgtgtgtatacacacacctgtgtgtatgtatacacatacaggtgtgcgtatacacacacctgtgtgtatgtatacacatacaggtgtgcgtatacacacacctgtgtgtatgtatacacacacctgtgtgtgtgtatacgcacacctgtgtgtgtgtatatgcacatatacatatacatatacatacacgtgtgtgtatgtatacacacagatgtatacacatgtgtgtatgcatacgcagtcttctgtatatatacatatatgtgtatatgtatatgcatatagtcttctatatatacacagatacgtatatatgtatatacatatataggagactatatatatgcacacatatatgtatacatatatgcctatatgtgtgtatatatatacatatgtatatatatgtgtatttttctcatggaatgcttcacaagtttccatgtcatccatgcacaggggccatgctaatattctctgtatcattccaattttagtatatgtgttgccaaagcaagcacaagagacaataaaaataccagaagttgccaggcattgggcagggaaagagatggctgggtggaactaatagtagtgaactattctgtatgatactgtaatggtggatacatgtcattatgcttttgacaaaactcatagagctatgtaacatgaagagtgaaccctaacataaactatggactttagttaataataatatatcaatactggttcagtaacaaatgtaccacaccaatgcaagatgctaataatacaggaaactgagaaagaggggagaggagtgtatgggaactctctgtactttcagctcaattcttctgtaagccaaaaactgctcaaaaaaatctatcaattaaaaaaatacatacatttatgtgcctatacatctactactgtgcatgcaaacaagcaaagttagcaggaataactgttgcattatgtaatcctttctaatattttttggtgtctattttatttattagtaaagaattaccttgaatatggtgagtgttagcaattatgaagctattattatttgttgctgtatacaacattggttgtatccctatgttacacaaacatgacagatattttagctgattaacctataattgcagggttcctaccaatgtaggcaactgcactttaaataccaattcacggtctgaagtatttaggatctaatggcagaaaagctccattttctggctttcttttcattgttcccagtaatattatttgatgtttttattggtggtagactttgattttgtatcattaaagttggatagaacatattttatggaattttacttgaaagggactattagaagcagaatagtctgtacaatttatgaacatgacttagaacacttgtattcatgtgacagtctcattcccatttaatctttaaatcagacattcacaacagaattttagagcattcttgcacacactggtgatatattctaaagaagacaagatgacctggttgtccacaatgacgagtaagcagcaattaactcttctcattacatagctttatgagttttgccaaatgcataatgacatgtatccaccattacagtatcatacagaatagtccactgctacaaaaatgccatgtgctccacctagccatctcttcctctgcccaacgcctgtcaacttctgatatttatatggtctccagtgcttgctttggcaacacatatactaaaattggaacgatacagagaatattagcatgtcccctgtgcagggatgacatggaaatttgtgaagcattccataaaaaattatatatatatatgcatatatgtatatattctctgtagttttttcttttccagagtgtcatatagagtcatgcaccacaattctatacccatgttgcagttacttttacaagaccttggaggatgtgtactgaccacatgcccagatcaggcttcagttccctcaggtacattccagtctcatgatgccatcatttgctagaaagtggcacagagtattaagaaggcagctctagaagaaaaagccttgggccagaatcccaagaaacacttagagcctctataactggaaatataagaccattcaaatacttttgagttttaaatgggcatttatatcttcagaaaactctgagaggcttacttgggccaccattcatagattccccctatggagaagggttaggagctacatatactccagccctcactcttggctcttaaatatgtcttcccagagagggcatgctttcctaatcacatagaagcagcacgggctaggctggcatcaccccctgttgatgacccaaggtattagtctgttctcacactgctaataaagacatactcaagactgggcaatttataatggactcacagttccacatggctgaggaggcctcacgatcatggcagagggcaaaagagaagcaaaggcatgtcttacatggcggcaggcaagagggtgtgtgcaggagaattcccctttagaaaaccatcagatctcgtgaaacttattcactatcaagaaaacagcatgggaaagacctgtccccatgattcaattacttcccatagattcgctcctatgacgtgggaattctgggggctgcaattcaagatgagatttgggtgggaacacagccaaaccgtatcacccaaggaacacatcagtgatcacttctcacacattttcactggagcacacaggctgaactccatgaactgtggtgtcttcattggtcaaatggggataaaggtactaccaccttggaagcctcctgtgaggattaactgatttaacatgtgagtgttcaataaatataagcaggtcctatcctactcatagcctagaattttcacaatgattaaagaagcgtgtaaactggacctcataagtcctcaatagtggatacctttattgctgataaaatttaattagatttatctctcccaccctacatcattctggtccaaagagcaggaactctgtagaactaagtttagtaccaaaagagatttattgaaggtatgccatattctaggcattaaaaaatactactattcattacttaatccttaaaatttctctttgaggttactattttatagtctccatccagatgagcgaattaagcagctttaaaatcatgaattttaacaggaaggacaagaaggaagagggagaagaagaaaaagaggaggaagaagaggaaggggaagaagaatgaaattaatatgtattcttagagtaacctgttaatctaaattaatttggtttatttgagtatatacctaattttcgagtgatttgtagggtttcaaatgtgttagcaaattagtagatatttaatataaatatcataataaaaaacatttgttaaaacatatgggaatttttaagtgatactctatattgcattttatattaatattatatttttaaaataaatttgtaatgttcaaaaacatgtttttctctaaacaaacgaaatacaaagttaacttctttataattctatacctatcctgtggttactatagattaccactgacacaaaacattttttccatactactatttaatacaagaattggaacagactattgatctagttttaacagatttagtgttgtaggtattttgttgaaaaatgatttccatcgatcaagagattgcttttccctcaagggaaatgagcccctgtctaaggtaccaacctcctcataaatagaatttgtagggagttcttatttccccccacgaggatgggatacaggtttaaatcacgattctttatcaaaagaagatttctcaccattagttaaacacaaaacactcagaatatgatatcctgagttttcaagtgtggtgactttccaatgttgttttttttgtttgtttacacacttaggaattttaagaaaaatataactacatgaagactattttttcacagtgggggtattattttcacaataaaaattatccatattattccatcttagaaaatttgagaattatattttataatttttattgtatatcagtttaaagattcttgttaatgggggagagagagggggttgtgtgtgtatgttcaatgaatcagtacaagcttccgatattatcagtctaagtcttgggtggtgtctacctccttgcttcagaagaggcagctctgatggtctcctcaagttccttggccagacccggaagcctgggcagtgtcaccttcctaaataggtctgttctcaagaattaactgctgcttagtgtgacaaataggaaaatgaaacaaagggggtgggggagggcacagatgaaaattctctacccctctacctactcctttcaccatcctcaggggctcctgatacaccagccaatagatctacactatcatttctgatagttttaataacccaaatgggctgaattatctattccaaagatctgtacagtagggtttctcagtttctgcactgtggacattttgggctggatgattctttggtctggagtagggaggggctggggtgctgtcctgtgcattgtgggatgtttagcggtatccctggcctctacccatcagatgccattggcacctcccaaccaaaactgtgcccagatcttgtcaaatgtcctcctggggtagaggaaaaaattaatccccctcaacccattgagagccactccatatatggtaatgcattagtgagaggcagaaaaagggaaagcctggatcatgaaggtaaatcctgtggtgcaactgtctagtgggatgcatttgcatgctctgtttctatgttcctctgttataaggaattaagccttacaagaagagtatgcaactcaaatattagtacctagctgacaaagaatttataactctgaagttacactgtggtagactagtatttcccagtcttcaggggggaacattaattagttctctgaaaacaaaagcttccctggtctctttcctctgaatgtacacgaacatattaaaggtccttgagtatccagtggtaaataaaaggcatttaccattgtttaaggttaaacaaagttctttaaggaaacaagattcttttctaatacccattcaaacccttttgtttccaacaatttgtaaagttgatgaataccatataaaccattccctcaaaatggaaggatttctaggtattctcttatcatagatttccacactaatttaaaatatttacactatcatcttgttactagagtcagatttaattgggactcagggttttacttgagaataatgttttgtgtttgtaaatgatataataatatatataaatatattttttatttatttatttttactatcggttcccattcaatagccatgagtagacttatgggcttagttaactcatatgactcttaatcaatggatcaattgcctgcatcaaaatgtgcttctgagtatttacttatttatgtatgtattttattattattatcatttctaaatacacccagggaactctgcggactgctgaaggagctttggagatatcaataaaagaaaatgatctagcacaattgcatgggcctgaccaataagaacatgccaatacgcattcagagccaagctcatcagcttgctagggcactcagtctggaggcagtctggcctacacagaggctgatgtcttagtggaaatcaggctcagagtcaagtgcaatgcaaagagccagggagaatgttctcctgcaagttcatctttacatgataataacaagacttaattaaaaatcactggtattttctctatttgtttcctaggcagaaagctcaaataccagactgtctggttcaaaattgaacacctggcaaccctaatgatttggtttacacagtgatttatgttgtgtcacagattcagaaatgtggtgtcagtgggggtaggagtgggggaacacagacacattcaggagaaaaagacctttactttcatctttatatgtttaattgggttaaaaaatgtttctcaggaaaaggaaatgttttcatctattattccattttattataggcatgtccatctctttgtcctatcatgtttccgctttttgctttcagtgctaatttccatagctttaacagactctgatgtctatcagatttgattttggtgttcctgacatagggctctgtcctaagtctgtgaaacagctaccatgtttcaatcactgtggcgatatgagtgtgtggtctggagccaaatggctgtttgaattacagctctactatttctcagctgtgtagatgagacacttaatctattttagccttaatttactcagtcataaaatgtggtggtagtgatggtggtggtggtggggggaaataatatctatttgtgaaaaaagtttagccttggcacagtggctcatgcctgtaatcccagcacttttggaggccaagccgggaggattgctggagcccaggagttcaataccagcctgggcaagagtaggactctctaattaaaaaaaaaaaaaaaaatgaaaaaaaatttcttatgagagtgaatgttctcacccctaatatgtgtgggtttcaggataagagtataaatggagcctgaatactctatctaaatatctcaaaattatgaattcccccaacaagttgctgaataaactgtgtgttgtctgcctgccttgacaaacataccttcaacatttaaaggtctgggtttaaatgtagaattctgaggctcctcagtgtcccatgctggaatgtggtggccttgggaaaatggaccttagctttaggcctggccctcctctcttcccaagctcttcttcacactgcaagggcctcccagatgatgcatgaagatcctggcccatatattcagctacatccacatccctagcaaaagggaggctaaggccattcctcaggcctagggcactgcccctggagggaagaccagtggaagatgcctggaaaggccctggaagtagcttcaaggccatttcgatagagaattctgggggcctgaaaacctagagccaaggggtggacctgggctcaggataggcaagtccccttgatccaaggtatcactgtaggaggaagggcagtcagaggagggccagagctgagccttctaatgcacagggcccagagtggagtgaggaacaatgctgggattagacacccaaatctactgaattagcgaagtccaagcaaagtactgcaaacaaggtctggcatatcacaagcaactaataagtgttacttttattattaagcacctactggatgtcaccttttagcactgaggatgtaacaatgaatagaaagtgatcactgctctgggatctgtccctctaatattaggcttctgcaccaacagtttgggctacctgctgtgacagggatatggaagtttgttaggtggagaataaatggaaacccctacctccctggaaggtcaagggaaggtcttacagaggaagccatggctgagctgagatgtgaagggtgaatatgagtttagccatcagatgactggtaaaggtggacagtccagtcaaagacaacaacttactggatacatggaggtcagaaagagcatggcatttagaataactagaaaaaaaaatgtttgttttgtgcagaggcagggtacttaggaggatggcaagtaatgaggttggagaaatgggcaaggaagaacaagatcgtgaatggtgagagtcatttccttagggagctacggatgtcacagtgaccttccacataattcagcatatctgctgcagaggtagccaagaaaccaagattaggacttcagctggacaatgttggcctgctggctcacagggcatggggagcaagttcacataaggcagtagggaagaggaggaaaactgcacacatccagggagattttagtgccagaattccggaaggctttcttccagaaggccctcaacctaactgccacgcctcctctcccacttttttatttagctacctcttatagactcatccttcagaacttagatgaagcattacacttcctccaggaatcccttcctaaattctcattctaattcagaagacattcttttgtatttctgcagtgtctcaaaaagtagattgcacgagacttattaattcattggtcagttttcctagaagagtggtttttaaactttatcatgaattctccaatgacttggagggcttgttgaaacacagatttctgaggcctatccacagactttctgattcagaaggacttagaattttcatatctaacaacttttccgatgaggctgatactgctagtttagggaccacactttgaggaccactgaggaaagagtttcacaagtcagagatttacagtggaggtaccaagcttttctcaagttagtttatcagaagcacaaaccatcaccctctaccaatcattataatgaagaccacttcatttcagtttatgtacaaaaactcatctccacagttatgccaagtgtatgaagacaaagaaacaatatcaggaaaagaggtttatttgattttgaatccttagccccttacacagtgcctgaaacatataagaggcagtgaataaatgcttattgagtgattacataaagagatgaatgggaggctgaggtgagcagattacgaggtcaggatatccagaccatcctggccaacatagtgaaatcccaactctactaaaaatacaaaaattagctgggtgtgatggtgcctgcctgtaaacccagctacccaggaggctgaggcacgagagttgcttgaacccaggaggcggaggttgcagtgagcaccactgcactccagcctggtgacagagcaagactccgtctccaaaaaaaaaaaaaaaaaaacctgttcatatatcttggacatttcaatttcagtgtactccagcagatttctgactgaccacatctgcatctccatgactgagggttttctagaactgtggaaggtccctttgcacaaggcaggctgaatgtgctagggaattaatgttctctaaagcagtcctcagcctgggaaatatggtgagactctgtctctacacaaaaatttttaaaaattagctgggcatagtggtgcatgcctatagtcccaggtattcggaagatcacttgagctcaggagtttgagttggaggctttggtgagctacttttgggagttggagaataactactcctgcttaattgcccttcggtaaaattttgaggcatgttctacacaatgtcccagaaatgcacagcagcattgagctctagttgccccagcagtcacctgcccagctgcatactattttattggcatctttctctcactacttgtgctcaacatctttgctcagggcatgtttccaaaggcatccaaactgaaaaggaggacaaggagctaaggataaaatatagatagatagacagatagatagatagatagatagtctagggagtatggcagagattccagataatgcaaattcagatgcacctgtcaaagtgacaaaaagaagattacaggcaaaagtagcagcagcaaaactggagctggctgtgagtcccccatcctgagtcctgcagttcatgatcttcatcccagatcccagtgtcacaggatctctagggtgttgcttttccagccggaaacctctgaggctggtagcgcctttgcccgaattttgcttgggcctgctgggcttattctgcctactcggcccatcagggtgcacttggctcgcgctaccagcccagatcccacacctgccaagggtgagctaggcacggagcagtgaagggtatgtgagggagctcagggtctggccactgtgcacagccaggctgtggtggggcgggcagcaccaggtgcctgcacaggcgccagctctatgcaaggctccagctgaaccaggcatactgcaaatggcttccgctgtggacgtcagggaacgtggtggcaccccgaagcttggagacgtcaggaacctcagagacccaaagagggtgttacagccctaactcgaggaggccctaggtctgagctccccaaagggctgcagctcttctctccttcccgtcgctggcaatgtggcaagcgaggggttgtgtttcagccctgtttgtgttacaactctttcagtcctgccatctggtgggtctgagttcttgtctggcatccaggaagaatgaggtatgtggacaactggaaggtgagcaaaatggagaggctcttccttgagtgacagaacagctctcaggaaacccatagtgggtagcacctttcctcaggcaggtcgtcctgataagcggctagcgttcagcagagaggggacccatactgggtagctcctttccacaggcaggccatcccgactaagtggaggagacctgaaatggatagttgattcccgcagctgttagtaccgtctgtgttaatctggcagagttagcggtgtttttatgggctcagaagggaggaagtgcatgctgattggtccatgggtagccataggcgggcctggagggagcaccataaattctctctgggccatggactccacccagaaatggcagcctggctcccaggcttcaggctgtccctggcttgaaggtggggtttcaccagggactcgcgcctttctccccaggaccctttctgcctcccgccatcagcatgccatccagggcacccaggctgttcgtgcccaggcccgcaccgagctgaccgcccccgctggcctccctcccacactcgtgagtacccaaagtccggaggggttgaggcgtcagggggctgtcatgtcagcgctgcctcaagggtgcacacacgcggccaggtggcaggagtgcctgggcttagccacaactttgctctgaaatcagagtgggcactgggagtgaggagaggccggagggcgggagcaggcacttctagcctgcagcgacaggtgggcttcccaggcccccaggagtacagggattcctgggtccggagctgtggctgggcgactgcagctccacctgggaactcagggctcccgccccgccaacttggtagggagtgggcctctggcctgctcctggcccccgtcggctccgcacgctgccctggcgcgcctacccctctgcacctggcgtcgtctttgcagcggacgctccagatgggccactgctgccattaccaggtggctgcagctggaggtaattctgcaggccgattgcccaacagagtaggatgggggattcacggagctgagagccaagacatcactttgagactcaaatccacacttcaccctgaactatccaggacactcagagctgccgacatttgctcaataattggtcaatttttgaccgtcactctaaccggaaatgcacatttaaaaactgtaccttcagcagctgctgtggaaagcagtttgacagatcctcaaaaagttaaacaaagaattgctacatgatctaccaatttcactttttggcatatacctaaaagaatttaaaacagggacccaaatagatacttgtacaccaatgttcatagcagcattattcactatagccaaaaggtggaaacaccccaaatggccatcaacagatgaatggataagcgaaatgtagtatatccataagacagaacatcattcagtttaaaaaggaatggaattctgttatatgccatggatgaaccttgaaaacattatgctaagtgcaataacccagacacaaaagggcaaatgttgtatgattccacttatacgaggtaaccagaataggcaaattcatagagacaaaaagtagattacgggtttccaggagctgggacaggggaggatggggcgttattgtttaataggtacagagtttcagtacgggggatgaaaatgttctggaaatggatagtggtgatggttgcacaaaaccgtggatgtaattaacaccactgaatggtatgcttaaaaatggctacagtgataaattacattatgtatattttaccacaattaaaaatgcatgtcttcatactaaaacaggtatcttaaaatgtttacctctgctgccaacgatggggaatgaaaaatcagtctcttgctatcctttcccgtggtgagctttcagctgccacactttctcattctcttccctcaagctgggccagatcacatgggcaggcagaggaaggaagacttgataaaaggtgtaattttgtcctgctgctgcttgtcgcagtatatgctttgtccattttatctgcttatgacccagttatttgctttttctctttatacacttgaggtaaccttggaaatgggctctaaaatctgaactgaaatgaaatggtcttcatgtacccccagtggtgtgatggtttgtgcttctaataaaataatttaagctaagctaagcgtgcatccactataactctctaacttgtgaaatctgtagcttcagaatcatcattcatcatttttgtcttccaagacactaatggaaattaaaataaacaaacctgtccatgttagaaagagaaaagatcctctacagtgacaagtttcacacaaattgcaatatgcataaaatatccaccaggttttaaaacaggtcatccattaagggttcaacagacacaagggagtattgcagttaaaaggtgggtagggtgttgtttaaccaacgttttattaatgaatgagagttcagacggcaaatgatagtctaacaacatcagtgtatatttgtgaagattaaataagactcatgtttcccccgtttggaggtttgcaaacgaaatctggcacaaaatatacaggaagataaactcgagaggaacgtagcctgtcacagtgattgatggggctgcttttcacccaacagtgtttgaaaatgtagatatccttaaataaatgacgccaagtgagccatgccagcctagggaattaagaagacattattgcattttgcagaaacaacataaagcactgctaccaaatttgatggttggaattctatatactttccatgacacctcacgatgtatatgctgcacaagagtgtatggtatcatttttagtaatgaggttaccaaggtgttccaaggtgaggcaaataactttctctgctgtgttcctggaggtgaattttaagactgcaaaatcagcagtatcattttctggaacactttaggaattcacctccacaactttcctttcccccagccccctcagtttagggtactttgaagagggactcaacatatagttgccaaaattgggggtgaggtgaggggatttataatagaaagtacaaagtttagaagtgatttattagcaagagagaaaagtattctcaaatggatgtaaattgtgaagcatttttttggtcaaaatcagcaagttatagcattcaatttgtttgcccatgatatattttgagttaaaaaaataaatactcataggcacataattaatgaaaagagcatagtattctgcatggtattttatcacctgtttctttcacttaacaggaattagtaatatactttgatgctaacaaaacatttttataatatatttagtagttgaaaacaatgctctgtcgtcaatctactttaattcattgttggacatttaacctggccctcccatttatacaaatagcactactgagaccatcattagagccagatcttgttttatatctttaattgtttaattagagcaaatgtctagaagtagaattgctggattcatgtgtcagtaaaaattttaggtcttttgatatgcattcatgcttatatcagcaggattcaagaagcccattttctcactcttttaccaccactgaatattatttaaaaagtggtaccaaggcagggtgtcttggctcaaacttgtaatccaagcactttgggaggctgaggctggaggattgcttaagcccaggagttccagaccagcctgggcaacatagtgagtccccatgtctacaaaaagtaataaatgaataaataaataaccggatgtggtggcatgcaccagtagtcctagctactcaggaggttgaggtgggaagatcacttttgcctgggaggtcaaggttgcagtgagccttgatcacaacactgcactgaagcctgggcaacagagtgagaccttgtctccaaaaaaataagtaaaataaaataaaataataaaatgtaggtaaaaaattgtagtcaaatttgggtatgcaagaaatatttttacttctttattttctttaagtgaaatttgatcttatctcaagccagcaactcaccctttccccacccatctgcactgtcaggaaaagcaatcagtgccattctttatggaacctcctgtcccttgctatggtcactgaggctcctacttgatacctagaaaatgggcaaagatttattacatcatggaggctgctgtgtcagacctcacagccccaggaagatgtgggcagttcattccaacggacaacaggatctttaactagacagagggaccctgttctttgtttttctctccccaacttggggcctaccaggaaatcctagggaccttcatcctcttctcctttcctagccatgggtattttcctctctggcactgccagccctgctccccctttttttttcctagtgtcatttcttttaggagatctggtgtcagtgaaaacaaaagccaggcatgccagctgtctgtaggcaacatccaagtccaagggaaggggaatggggggaggatggtctgcctacttgaaacagaggagccagaaatgaagggaaataaagcacaaataaatacttcaattaagtattttgacctatgtgtatgaatttgtctgtgtatttatagtcaatttatcagtctctctagttagttctaatagatttctttttcattagaacttgcttctcaaaaattatcacattaatactcttttttcgtgtttaaatgcaatccatcttcctggattggtgctatctctggaaagaacacttgtagaacttggatgataatgcttttatatgaccagtcgataatccataattgcagtacattacgatgaccatctatgtcccttttgtcttcactggtggttctcaaagtgtagttcccagatcagtataatcagcatcacctgggaacttgttagacaaattattggtcacaactccagacctactgactcagaaactctggtatcccccttccccccaccaatcagtagtttaacaagcccttcagctgatttcagtacatactaaagtttgaggactgctgctctacatcatcatcaatcataatcacgcactcatcttgctcatgggtactttagggtttccaaaccctttagatgattccaaatcaccaccgtgatttttaggggtaaggttaatgcaacaatacactaaagtcagtgtttaactgcacaaaaactcaccatcatctttctatacccaaagttgtgtctttagaaaaccatttctttaattggcaggcaactccagaattgatcatgtaggaaagcaaaattcattagcacgaactgtacaaaagtttgcacatcaaaaacccaaagcgtctcttctttttataaagatttagttacaaagataattataaagataattatgaaataattatgatttatatgttatataaataatgtaatcaatatttataatagataattataaaataatctttatgtgttcttttagaactataaaaattatgtttttaataagttttttattaaaaattggtctttttatgagactaattacaaagattaaagtctcctgcttagcttatctgtggtttgagtagctccagtagctcgatgggttagtgtgcagtggtacttatgcggtggcactttcatgacatgtggtttgccctctgaagctttgtgatctttcactgcattccaatactagaaataacatctttacatttttactctaagtcagttgccgccttgggaaatcaacttgtttttaggtgcttggttccctaagagggatatgaggagagtagataattttagtagttattaatgagaaatcctcaaaagccatacttttttaaattcttgtttttgaaacatttctggcacgataatacaggttgagaattaaaaacaagttttctcatttggcatgtttaagtgaagtcacttgcccagagcaggtactgctgtttatggcctcgcctgaatgtttgtggtacaactctttaggatgatgcttctgccaggactgtcacatgtacatgatttcaaatgtgctggcattttagtcagtgtattggagatagagtcttaaagcggctggaagagaacaatcttccttactttgattactttctctctctttaacactacctcatgcctttacttttaactattttaactttaactctttttttttttgaaccagacttgatgacaatccaggttgcaaattttagttttaccatgtattagctgtatgaacatgttagtttcctcatctataaaatggaaattttaatctatacctcacaaaacaatcaagagtaaatgaattacaattagacaggaggactaagggctactgttctatagcacagtatgagagtatagtaaataataatttattgtatatttcaaaatagccagaagagagaattttggatgttctcactacaaaaaaaaatgagaaatgcttgaggcaatggatgtgccagttaccctgatttgattattatacactgtatacatgtatcagaatatcatatgtattacataaatatgtacaattatgtgtcaattagaaattgtaaaaagggtaataaatgagataatgtatttaatgtgcttagaatatatgccacctagctaataacattattagcacataagaaataatcatatagttcttttacatcgtttcttaattctttggtatgatcgaaaatagaaattataagatttcaaactgcatttatatctctggataatttttacttcaaaactaggttatgtacatgattaacttttatttccaaccatttcaagaaaagaatatggagtaaaatcttatttataaaggaggaaatgaggtcttctggttgtaaatgacgttttatttacaacctggggacagcttccaatttattcagcaaggaattctttccaaaagttttttgatgtgagcagtgtatttatcttgtgctctgtttctggcccctgttattggttgtggccaagaaattataaaatataggatgaatctatcaggaactttgtgagtgtgaatggccagaggccacctgtccatgtgtgtgactctgctatggctgattcaacaatgcagcaaaccccagcagtttcagtagttccacaccttccgcttgttattaaggggtgacgttcaatgtgctcatgaggacgaggtcaggcctggcccaacctggaggccaggtgatggtccctagttggatgatctgaagacatcttttgatgcagtttgggttgaggaaggcaagagatgtattgatgctatcataggagtgaatcaggtgaggtaaaggcaaggaaacatgatatgaagtagaactggattcattataatatatgtgtgatttagtcacacaaatataccggcaaagaatgtcaagtgttaatcaaataggtcaactaataattgagggccaggcaaaggcaagccactgtcagggcaaagaagtgatacttttatctcaccccttatagagtccatggctgacacccctgtaacaaaggacctaataggagaaaagcataacaaatttatttaataaagttttatgtgacctgagagctttcagacacaaagaaccaaagacccagggaaaactgtgtttttttaatgcttaggactgatgaagaaaggacagtcacacagaaatgtgattggacaaaaagggtataatttgatgttaatgaagtataggagagaacctagcaaagcttgtttgttcacattcttcttggcctctctgtgtagcattcctttgccctggttatggggcaagacacctggcacaagaagcttatgacctgatcttaggggaggtaggtcagagagtaaccttttctaggttttatggctttctttggggaagaggagttgtagtttctatgacacaccttggtggagaaagggaatgggagaaaggagggcaaaggaaggttggagagaccttgcttttgaagcccttccagtctcctttacttcaaagtattctgcatggccaggtgccatacttcatggtattgtttaatgagccctgacatcacttaacaaaccacagtggcagatttcaagggatgttgtcagggagagtgggagaggagagtgtgatagacaactaaacagaaagcgactctacagcttgctaagggaagaagagagggaagcattaaatgagaaatcaactggagacagcaggtacttacggagacagcagatacttttagagacagcagatatttatagctggcgtcctacaccagggtttactttcatcatcccttttgttttcaaaactaagggtcatttttttcaacacaatgtcattatcagaacctagttgttgtaaagttttggatgctcccaaagtttctggagaggtaggtgtctgagtccttgcttccttccacaccttccacttgttattaaggggtcgacgttcaattacttagtggcatttattaccccaagatttctataagtgtcctcttggatgtgaagcattgttcatatatgaggggaaaagcaggtctttttgctgggaaccatatagaggtgatctcatagctttgaagtaccttgattggctaacacggtgacaccctgtctctactaaaaatacaaaaaattagccaggtgtggtggcacatgcctgtagtcccagctactagggaggctgaggcaggagaatggtaagaacccaggaggcggagcttgcagtgagtcgagatcgcgccactgcactccagcctgggcgacagagcgagactccgtctcaggaaaaaaaaaaaaaaagtaccttaatgcagcccctctcaatagtgtatttggctgggtccactccttccttttacttcccagatttagcttaattatggtgacaatggtttactctctctccattccccaccctgtttcctaatgttctttagccaagggctttgtagaaggactatgtttctaccagtggtatgtcactgaagtgggctattgaggtgaccaattaggacaaaggtgaggagtgtcttcaggggggtctttatctcatgtttcattcccttgtatggattgctgcttcctctacctttttggattgccaattccccatgtctacttttcttctatgggtttaacatagtgttttctctgaccctatcggaacattgttcagcagatggctttatataaagttattttgtttgctattaagcatcttagctatgctcaatgttttggggctgaattgttcattgtggcaatttgtaatatttgtaatatatttaagtaactctagagtcttggcttttaacattctcattcaattatgagggtcaggtcttgatctgaactatgtgtttatggccttttctcaactccttgtatagagatagttttccagaagtattaatgattgattgaagcagataaaatcttttatgttttcattcttttggaactcactttttggtggaaatacttgcaattcaactaatttactggtatgacttgttatatggattcttgacatgatgattggtttttataaatttgagctgtatttactcacttccatgaattgtgcagttatgaaaatttgaatctgctagtttctgatctccatttgtggaagaaaaagccaataaatgggaaagttattttaattctataatgctacatctagaaagggcgtgacaaatttttgtttgtaatacagttcccagtcattggaaggggacatctcttggtctgagtaatattcttcataatattaacacctgctcaatattgagcaaaacttcaattgcccacttctggccatatatccaactttagaaagtcatgtacttctagattttatagaagaatactacttctagattttgatttttttaaattaatttctctctctctctctcttacttttttgagacagggtctcactctgtcacccaggatgaagtacagtggcatgatcatggcttactgaagcctcaagttatcctcccacctcagtctcctgagtagctgagaccacaggcatgtaccaacacacccatcacacccatctaaatttttaaacattttttgtagtgatgggatctccctgtgttgcccaggctggtctcaagctcctgggctcaagtgatcctcctgcctcggcctcccaaagtgctgggattacaggtgtgagccaccacacccaaactgaattttttaatttatatttttcagatttgttactgtacccttcttgccattgagtacttaatttctccatcattgtttcttggagttttaatatcgaaatgcttcattatattgttcaataatgcagaatgtttgaatttaacatagagatttttaggcccataggctgaaataagtcatcaaaagatggaaaaacatatggtgatgaggcatgtcatacatgccaagcaggattggaggaagctggagaacttgaagccattcagggacaagaagattagcgagaggatttcaaagaagtttggagccccaagtcataagaaataaacacatgattccttatctcagactttactagtgaaagaaaaaataaaaaacaagctctctttcctagggatataaattatcctatgacaaatagaaagtgaaattctgtaggttattttcataacagaccttccagagaatttgctgatgactggaaaaggggaaaatgcaggaaaaaaaaggtataaatcctaagagtttctaaagtagccaaacaaggcaggaaaatgtctaatcttattgtgcaaaagggaggtggaatctgtgtggaagaaacagtaatataaaaataatggtacatgttctcatctgtgtaatgctcaatcatttccagtatgccctcacctggccacctgtaggagtatagcatcctacagcagaatgggacgtgtgtttggctgaggcctgactctcgccccttatagtttatgacaagagtattggggccaagcagggaagaaacatggaagaaacatctcattctagggcccacagtgaattatggccactgccgggacagagccagaatcatctcaggataggtatcttttacccacagatttctgcctcaggattgtggatgaacttgaaggtccctgtcttagcacctgaaattccatcagcagaagctcagcgtgccatagtttgcatagaacagaagcaggaaatcttaatgatgaactctacttacatccctttaatgggatcatggaactggtaggcaagaagcctagattgtatcttgcaaatttagagccaaatcttactgaaaggaatgagggaatatagatgagtagtgactactttatttttctacaacactgtttcctttttgagtcctgattctgctgacatggcacggaactttaagctcaatggtttaggtgtttctttcccttcctggggttgtatcaacattcctggaagtttgtgtggaactaggcctgggtgaaagggacccagctgttccttgaacctaagtctgctttgctgtgtccttcattcctatctatgtggcctctcaggtctagcaaacctcctgctgctttggtggcttgcttagggcatagtaagccactaggactccatgtttctatgaccaggcagtggactgaatttgttccacagacgcattttatttagcccacaaagttttaagaatctggaaattttatttgaataatgtagttttcagatttctcttgaaaaatgggaaatactgtaactcagtgcctgcattcttgcataggagcagccagctggctggggctgtgcctttgcatagggcattgctgtgcctttgcatggggcattggctctccaggcccacacaggcccctccagtgtccattggattccacctagcttccttcacccacttgagttttttgcatgatgcctccacgctgcacacccacattctctctctggagtttgtccctctctgagtggcttcttttgaaagattgtcttgggcccctgtactcctgggccttcagatcttcctttacttatcgcctcttcccttttctctttcccccagtcaaaaagaagcttttgcagtctgggcatggtggagaggagctcttttcattcactgtgcttctctctaacactttgtctgtacccctgattatggcctccacttcagatgccagtcacacatccaggcttcccgtatttctgaccaaccagctgatcagaggttcccacgacactctcctcgggtttgatattttattagaatggatcacagaactcaggaagacactttacttaatatgaccaatttattacaaaggacacaattcaagaatggccagacagaagagatgcatggggcagaaagaggcatgaagcttccaaaccttctctgggagcgccacactccttgtacctgcatgtgctcagcacccctgaaactctctgcactccattgtgtagggtttttatggaggtgtcattaaataggcatgattgattaagtcattggcctttggtgattgaattcaatctacagcctatctcccctccatggaggttggaaggtggggctgaaaggtgccaaccctctcatcacatggtcggatcctctggcaaccagacctcatcctgaagctatttaggggcccatcaagagtaatcctattagcataatctcaggtgtggttaaagagccttattatgaataaccaaagaggttcttcttactcctatcactcaggagcttacaagagttttagggagctctgtgccaggaactggggactgaatatatatttgttatatcacactatcagttttgaaattcaaaatggcacaatcaagattattcctgttttctcccttaacacactccttctctgagtcaatgagtacatctgtgcggagtgtctcccatttgccctccagacccactcttcccatctttcccattctctctgcctggagagctgatctgtatggactgtctcaatggacttctctgccttctggcttctttttgggtttggtcaatgggcagctctcccaggcagtctaaggtaaagaggagagtaaaggtgaggtgtttgctttttgtgattgtctacatgtgctgggaactacactttcttttcaagccttttggcttgaaaatgttaacagtgcctgcttgctaacttcagggaatgtcactagctctgggggttgctacagccttcccacatctttgtaaatagtctctattaaacactcaaattactctgtttgaaagtgccatttatttcctcttgggactctcacagataaaacgttatgtgcagttgtttatccatagaaatatttaataatatttatacagattttaagttttgtctaaaaatacattcaatgttaaaatgcagcatctgaaccttatgtcaatgtaagagttttctacaaaacagtcatatgtggttcaaaacacaagaggctgaattgaagctttttaactcctacatcacaaccttttaacacacaaggaatcctgagtgcaccagtttctaagagaacctaacagtactaaagatgatctagaaaaagaaaagaaaagaaaagaaatggggatgaattgtctgaggaagaattgtcagtaacaagttcatcatggccgtcaccctgcagaagaccctaatcagaaaacacagcttcacgcagctaaatttttaatgctcttctaaataatgtctgaggttagaatgtcagcttgggaatcccaaacatccagtaaaatgggacacctttgccacctctgtgagagtgttctgaccttgtctgtgtttttctccccttcagttcactcagcaacacagggaggtgagtaaaggatttggcagcacatttgaggcccgggggagaaagagtgcttgcaggcatgtctccacgttgcgcggaaaacatgatgtttagctgttgaaactattgtgaaacttggctttcttccttagtttgcctttttaataaattcctaaatcatgatttgattcataaattacaaatatatggtgtttgtacatgtgaaatacaagatcataaccatggagaaaggccaccattacccatagatttttaatcaaacaaattggtttattctgatgtttctctgataatttctctccagaccagggtttttttttttttttttttttttttccctttctgataacacaccacacttttggactatctacacaaatagctatgaaaaatggccttgttataactgagggaacttcattatattgaagtgctttttgaaaaatattctaaaatatgaaaactggccatccgaacaggagagcagtatttctgagggtgttctgctggctcgcctctccacgtctgacctgtcttctttgtgagctctgaatcttcctgtcacctcttcaacagcagtgtgttctgcaagtccagccttctcctctctgtggcgtcctttcggagatcatctgtacgctcaaggcttcagttaattacttgaataatgtatatatttaagcatcttcttcgcctttttctcttctgttttaggtcttctcagactcctcctagaacaatatagaataaatgccacataaggtaaaaattaaaaaatacatatatatatataagaaattcaaataaactgttttgtaaaagtaagagacaacatatggatcagtaatttaaaaatatatctccgaaccttcccacatgatgacttctaaagctataactcttacctcgtagtctcttttgaacataagttttgcaaaaagaatggtccccaaaaccaaaacatttcacgcacatgttcttccattaccgcagatttaccatgaccaagattaaacccaatgagaacatcttcctaccaaaaccctttagacggtctgtttctgtctgtgacacaattactcccagtaaacaagtgtcacgtctgtgtttttgcacatgtgtacctaggtatgtgtgcgcacacacacatgcatgtatgtattaagaaaggagttagtgtttattgttttaaccccacttcttactctggctgtccgttcccagtcagtttcaaatcttggattcttcttttgaaatgactcttaaagtcccccttcttctccattccagttgtgtttcttttaatcccaggctacagtcccctcacttctggactatcacaacacctgtccagttggcctctctgtctactctttccacgcctaggttataaattactcagttgtagctattatacctcataactttctgttccttgactttgctaatgctttccttctgaaaaggaatttattaatctgggctgttggtcctgttcctcttaacattttgtcaactatacttcaattacttgcatctgattaacagctgctgtgactttccctaaagtagaacatatttctttatgtctctttgataactcactgcattcattggttgcccttggctgaaaagcacattgcttatcaatgtgttttgttcacaatgatctggcagcccaagcatgatatttaatgtaattgatgtctcttatttactaatggatgttacatcatcattatttagaaaatttgctactgaattgacatctgattgaggatacgtgattgaggttaagagcctgtgaatgtttggagaatacttgtttatagtatgtactgtgcagtgtggtgtgctatctacaggctgcagctggcgtttccttctgttaatattctgtacttgatgtggctaagtaggcactgagatgctcaacttcagtgtttcctcctacctactgaaggacaaaacacttactggcagcaatcatctgatgcaatgtaagtaagaatgaaaaaaatacaggacacttatggaattatataagataaaaattagtatgatacacccatatttttaactcatttgtgtcagggtagttttaaatgaaagtgttattctaaatatggagaatctaaagatctatgtagttttaataatttattataagagaacttgagttagaggctttggagtgtcagtcattaaagtttactaattattctagccaccctgcccctccaattctgggtatatggtaagactgcatttactggagctcttctgattggacagagtttacaaccagttttacccactgagttgtgagtagcagtggctaaggcttttattacagtgtgattaggtttcctttgctttcattgcaacgtgatgaggtttcctttgcttttattacaatgtgatgaggtttccattgccaccatggctagcaatgatcttcacagtggctattctgtcagcctgggacccacagtgaagacattatggaacagagtttagccacctgtcactagacatgaacaagaaaaaagaaatacataatttttttaaagggctgggcatggtggctcacacctgtaattccagcactttaagaagccgaggcaggcagatcacttgaggccacgagttcaagaacagcccggccaacatggtgaaaccctgtctctagtaaataaataaataaataataaaaaattagccaggtgtggtggtgggtgcctgtagacccagctgctcaggagactgaagcatgagaattgcttgaacccaggaggcagacgttgtagtgagccaagatcagattgtgccactgtactccagcctgggtgacagagcaagactccatctcaaaaacaaacacacaaacaaacaaagcttcgtggtttgaagccactgatatgtaaaggagttttgttaccactgcataacctagtccctcctgacagatacacttggtgtgattctggttatctctttgactgtttcatctcatgtaggttacttaatcctctcattctttttacttttctgtaaaaaaaaaaaatgagtatagtatctacgtgcctaccttacagggttattataaagaccagattagataatgatgtatgtgaacgtgttacacaaataaatatacatacatataaaatatcattattattttctatgcaatcagataaacttctccagtaatgaactatagaaacgattcctgaaagagtagcctttaaaatattatttttaagtggtattcatttttggagcttaaaaatggttcttcattttaaacataatttatgctggtgctaagtctaaagcataaagaaggataaatgtataagaaaaatctttcacctcaacatacccccatccacattctcaattatagatgtgcctactgttaaaaatttcttatgaataatcatagcagtatttttaatacataatgtttttcaacattgttctgtcacttaacagtatattttgaacatttttctcattttttttctttttaatggtttcatgatactctactggataaatgaacagtgcattatatactttttcaatcaaaattttctttttaaaatttttctttgaaaaaatgaataacccttatcacttaacacagcttaaattattttttttaatgtccaaaagaaagaacattataggaacagatataatacatgccactgtctttgtgatgggaagtaaaaacaggataatagtaatatttatgatgtggaatgataaacagtaatgcctatagagatcagggagataaattagtaaaatcagagatgtgggctaaggaaaagcattgcaaggagagagaagggtaggaagggaaagaaagagggagaagaagaaagagaagagggagggagaggaagagaaaaaagaggagagagacttgttgccaccaagaaaatacatgtctttctaaaggcagctgctactcagctgaagtccactgttttcaataacaattctatctcatcattggcaaatattatttttcaagagaagtaaaaaaaaatcaatatatgtatgattttgattatttaaagtgagaagctaaatcagaaactttatttttaatgcataagccaaattacatttgttatttggggcaaccagatatagtcaaggcatagtgtgctaccctctaagataaaaaatataatacaggcacagagttttaacgtgtcttaaagaatatagctacatgaccgggtgcgttggctcatgcctgtaatcccagcactttgggaggccgaggcaggcagatcacctgaggttaggagttcaagaccagcctggccaacatggtgaaaccctgtctctactaaaaatacaaaaattagctgggcatggtggcaggcacctttaaccccagctgctcgggaggcagaggcaggagaatcgcttgaacccaggaggcggaggctgcagtaagccaagattgtgccactgcactccagcctggatgacagagtgagactctgtctcaggaaaaaaaaaaaaaaaagaatatagctgcatattttggtcttgtcttcataatctacctgtgtttcataccatagaaagcttcctgcctctaagcatgttttcataaacctacacaaccagcttcagttagcagaaatccttaagaaacaatattttagtgtaattttatttccagtctgtcttgtgctctaaagctcttaacaatcatacaaaaggagcttttgatgattctctctttgacttgccatttaccacctctttccatatcagaaatcaaagtggaattatgcatgttaatatggttgtaatttgactttcatatggtactgactaaaaagcactcaatacagcataccacattggtgtaaaagcaaatattttattaaagaattttgaaaagcacataatttatctccatacttttttcataattgattagttgtacaacatgcattttgataaattcaattacaaaataaaaatactcgatactcatatataaaaagtaacataattttaacatttttgtctatttacattggatgtttaacactgttgtctttttacactttctatttaggtcttttttttttttttttttttttttttgagatggagtcttgctccgttgcccaggctggagtgcagtggcatgatcttggctcactgcaagctccgcctcctgggttcacgctaggtttcttcttaaatgacctaaatgacatgagagatgcaggctgcagacattttttaaagtagtgaaatgcttgctctagagagtgtttttaagcctaggttgctttaattaataaaacttgtcatatatctcaaagaagggaaggtatgtgaaaaaaaaaaaaattcatccctgatgtaaggttgaatgcataattatttatacatatatgtaaattagaataaagatgactcttggttgactcaaagggtgttcaaaattggaagttattcttttatggaaggattttattataaaatgtaaaattatggttgaacaaagaggttttgttccatttggttatacatgctgagaaaattcttcatttttttaataagtctgaatatctcctttccaaacttggtaattttctggagtctaataataactgaaatccctttttaaaaacctgccaagagaacccacttttctgtctgatttaactaatgtaagtattagatttaatctgtttagttagggaaaaattagtttgtgaccgcaaatggctgtctgcattagttatatccaaatgaacagagtcatttttggaacattttttgatatccatttttcgtttacttggctagtttcccccaactttatcagttagggttcacagagtagttctacagaaccagaaatcagtaggagatgtgtgtgtgtgtgtgtgtgtgtgtgtgtgtgtgtgtgtgtgtgtgtgtgtgtgtgtgtgtcatagcagctgacagatccaaaatccgtagaactggggactggcaagcttaaactccatagggcaggcaggacagcgggaaacaccctggcagtggccgaagccgcagtctacacatgaaatttcctcttcttcaggaaaacctcagttttgctcttaaagcctttcagctgagtagatgaggcccactcagatcatcaagtataatctcctccacttcaagttaactggttgtagatgttaatcacatcaacaaaatagtttcagagctgcatcttggttagtgtttaattgaataactgagtactaaagtcttgccaaattgacacatacaactagccattataccatctctttttttttttttttttgacggagtctttctctgtccccgccaggctggggtgcagtgacgcaatctcagctcactgcaacttccacctcccaggttcaagccattctcctgcctcagcctgtcgagtagctgggactacaggcacgcgccactacgtccagctaattttttgtgtttttagtagagacagggtttcaccatgttggccaggatggtctcgaccttttgaccttgtgatccgcccgtcccggccttccaaagtgctgggatcacaggtgtaagccactgcgcccggccggcctataccatctttttataatcttcaaggaattttcttaaatcacctgactgagttccttctctgtgctcattctgtgcttgctgcattcatctgtcttgtaatttacaacaccatattaaggctagatatttatatgtttgtcacggtcctcaaactgtgtgtgctccttgaggttccagggaattagccatctatctttgtgttctctgtgcctagtgtgatgggtggcatatacaggcatcgcttgttttattgtgttttgctttattgtgctttgcagatattgtgtctttttacaaattgaaggtttgtggcaaccttgtattgagcaagcctattggcaccactttttaaagagcatgtgctcactttgtgctcctgtgtcacattttgataattctctcaatatctcaaacttttttgttattcttatctattttatagtgatccgtagtcagtgatctttgacattactattgtcattgttttggggtgccacaaactgtgctcataaaaggtcacaaacttaattaatcaatgtgtgtgctccgactgctccactgacctgtcattcccctgtctgtctccctctcctggagcctccgtattccctgagacatgacaatattgaaaccgagccagttaataactctacaatggcctttaagtgttcaagtgagagaaagaattgcaggtttatgttaaatcaaaagctagaaatgattcggcttagtgcggaaggcatgttgaaagcagagacagccaaatgctaggcctcttgtgccaaatagccaagttgtaaatgcaaaggaaaagttcttgaaggaaattaaaactgctattccagtgaacataagaatgataagaaagtgaaacagctttatgggagatatggagaaagttttagtggtctggacagaagatcaaaccaggcacatttccttaaaccaaaccctaatccagagcaacgccctaactctcttcagttctgtgaagtttgagaaagctgaagaagctgcagaagaaaaataggaagctagcagaggtcggttcctgagatttaatgaaagaagccatctctgtaacataaaagcgcaggtaaagccgcaagtgctgatgtagaagctgctgtagccagttatccagatctagctaaatttactgatgagcgtggctataccaaatgacagattttcaacgtagatgaaacagcgttatattggaagaagatgccacttgggatgttcatcactagaaaagagaagtcataggttggcctcaaagcttcaaagggcaggctgagtctattgttaggagctaatgcagtgggtgactttaagttgcagccagtgctcattggccattttggaatttctatcgtccttaagaattatgctaaatctactcttcctgcactctataaaaggaacaagaaagcctggatgacagcacatctgtttacagcatggttaactgaatattttaagcccactgttaagacctactgctgattaaaaaaaaaagattattttcaaaatattatcgcttattaacaatgcatctggtaacccaagagctgtactggagatatacaaagagattggcattgattatgcctgctaatacaacattccttctgcagcctatggatcaaggagtaagtatgactttcaagtcttattatttaaagaatacattttgtaaggccatagctgccatagatagtgattcctctgacaaatctgggcaaagaacattgaaaaccttctggaaaggattcaccattctagatgttattaaaaacatttgtggtttatgggaggaggacaaaatatcaacatgaacaggagcttggaagaaattgatttcaactcttatggatgactttgagaagtttaagagttcagtggagaaagtaactgcaaatgtggtggaaatagcaagagaacttgaattagaattggagcctaaagatgtgactgaattggtgcactcttgtgatgaaacttgaatggatgagggaattgcttcttacggatgagcaaagaaactggtttattgagatggaatctgctcctgatgaagatgctgtgaacattgttgaaataacaacaaaggatttagaatattccgtaaatttaattgataaaagtagtggcagggtttgaaaggattgaccctgatttttaaaataaattctactgtgtgaaaaatgctattaaatagcattgcatgctacagagaattttttgtgaaagagtcagttaattggctaacttctttgttgtcctattttaagaaattgccacagccaccccagcctcagcaaccaccaccctgatcagtcagcagccatcaccatagaggcaagactccccactatcaaaaaaatttcagctcactgaagactcagatgattattagtgttttttagtaataaagtattttttaaattaaggtaggtacattattttttagatataatgctattgcacccttaatcagctacagtatactacacacacaactttgatatatactagggaataaaaaaatgtgtgtgactcattttattgtggtggtctggaattgaacatgttaatattgctgagatatgcctgtattaggtgctcagtaacagcactccactgtagtacaaaatgtcatttaccacattacagagggagaatagatcacatttagcaccttagcttacctatacccacaacttttttttgttttgttttgagatggagtctcactctgtcacccaggctggagtgcaatggcatgatctccgctcactgcaacctccgtctccaggttcaagtgattcacctgtctcagcctcccaagtagctgagattacaggcttgtgccgccacatctagcttttttttttttttttttttgagatggagtttcactcttgttgctcaggctggagtgcaatggtgtgatcttggctccctgcaacctcttcctcctgggttcaagtgattctcctgcctcagcctcccaagtagctgggattacaggcgccttccaccacacccagctaatttttgtatttttagtagagacagggtttcgccatgttggccaggctggtcttaaactcctgacctcaagtgatccgcccaccttggcctctgaaagtgctgggattataggcatgagccaccacacctgggctatacccacaaattttgaataagatatataatgtaaattttaagggcatggtaatataatacaaacaaatcatcaggagtgaggattcctggtttttaattccaatccaggacctaaccggctggctgtgtttcagttcacccatcaatctctgggtcttggttttctcatctaaaagcatgaaggttgagtgagattattgtctctggttcagaagtggcctaatggtttacaagaagactgaacagatgtattttctccccctctttcttcaaatgcattgaaatgacagtgaagaattatagcggagaacaaatacatgacaggaaggtaaattgggaggcggggatgggaagggaggatcatcagaccagagttatgaatttaatttttgattaaggagaatggatggaatattgtaatggataatattaagtggaacaaggtttagcccagagtatatttaggaggaggctaaatgcaagggctactgtcagaattgccagcttctggaagctggattgggtggagggacagaaagcaacatcttttttttttttttttgagatggagtctcactctgttacccaggctagagtgcagtggcgccatctcggctcactgcctcctgaattcaagccattctcctgcctcagcctcccgagtagctgggattataggcgcccaccaccatgcacagctaatttttgtatttttagtagagacaaggtttcaccatgttggccaggctggtctcgaactcctgacctcaagtgatccgcctgcctcggcctcccaaagtgctgggattacaggcgtgagccacagcacctggccgaaagcaacatctttaaagtctacttgacagctgcaagacagcacccgaccccctcctctgtatgcagactaactggaagtctgacatttatggccaggtaaaacacagagcactcttctctcatgaaattagaggagctgagggagctaagcatttctaaagtggatgccagcaacccaaagataacttcgcctcgtcctggctatttgtgggaaacctcagttcaacagcttcttcatctttcagggtgaagtgaaatctgccagtttacatgccttgccccaagcactcagagctcccggcgagactcctgttaactagactgatgagttttttgactaaatgcttcattttccaccctcccttgcagctgaccatggtcatgtgattagattctggccagcagtatgtagacagcagtaatgttcacagctgttaggtgaagcccttgaagagatggcacgtttctttccccttccactcaaactacttggttcaacagtaaataactttaacatggtcccaattgtgtaaatttagctgtttaaaaaaaaaaagtttggaatcaatcaagggataatgtaaggaagactaaatcatggttataggacaaaatttaaatattttaaatgaaaaagaaatggtaaaactaaaataacctgtgaagagtcaaatatcatgtgtaactgatgtaacagcaaagagatttttaagtatatgattgacatgtatgatcacaacaacaaataagaactaatcatataactttcagatatcaggagaaacagataggagtggagatggggatagtaaaaataagttgtaactttgttaatagaagccaaaataaatttaaaaactagaagcctaagttcatcacaaagagttatgtggttacctgaccaacccgaaacagaagctgtttaagatgattgtctctggagaattaaatggaattgaggatgggatatatgagtcagagacttgtgtgtctcattttatgccctaccatatatattttttaaaaaagtgtgtgtgatagctttatatgatatcaataatgacgataaattacatagccatgctttaaaataatgccatcctaattttattaaagtaacttttctttacatgataggatatatgtacatgtagtatgtcaatttaattccctccattttattccaggactgccttccttaagtgttttctgtgttagaggatattttcaggaaaagcaagtgtaaagtaaacatttctccttggttattaaaaagttctaaagcccatcactagttgggatgctgtcctccctgtggtcatcagaataattcagagatcagattattctggtttatgtggcttgttctgggcaaatgagcaggccaagctgcatctcaagggttggccaacttctcagaggccatatatggccttctactcagaagacttctcctgcatataactacaaatcctttcccatcccaccttgcaaccatgacactaaccgtattgcattatgtatgtttatgtatattatgcattgggacataggtgagctcagctaggccatgacatcccacagttgagacaggtttgcttagaaagcaggtgtctgggtgtgaacatttgtgtgtcccattaactgccattcccgatccattatatcaatttcttcccttcccctgtagtctttcatccttggagcctggctcaggggattcatgggacagaaaagacaggatcggaatcagaatgttcttttttttgatctctcactgccccttacgttttattcagtgcagatagtttttccctgcccctaaatgaaaacttgatttgtctatgactttcctgttgatcctgagatagtaaaataccctgtcgcttggcagacaatcatggtctcaatttagaatttataatatcaagtcatgtgtgtcagaattctgaagttgatttaaagttcactttttctttctttcaccttgtctgaggcctgctatggaccggctgctcgacgtaggggaagggcatagtctttctactttctttttataccaaccatgtctcctccattagcttgaaaactgaagtttgtgattttactagggggagtcaaaaaaaggttaaagggggacagatgtagaaaagttcttatttgaaagctggcttcatgctcttacagtttcttcatagactgtcccccaaccccagcaaccccaatacctggtgatctgtcccttgcaattcttttgacctggggggttgtgttctatcttgtcactcattttcttctcaatagggttgccagatacaatacaggactctcaatcaaacttcaatatgagataaataatattgtcttagcataagtacatcccaaataatgtatggaatatacttatcctaaaaaattatttgttgtttaactgaaattcaaatttaactaggcatactgtatttctatttgctaaatctggcaactgtaggtagaagatgtttttcagggatgtctgcttttttgggccaaccaaatctggatatttaattatgctatgctctactactacaacattatttttccatgtcaagcaccttttcacaaatataacatcttaaaagagcttcgtagagcaactgaatatgttataaacttttccttctttttaaaaatgtaaccatctgtccaaaactgtaactcaaatgttaaacatttagtacattaaaaaaattatatcagtacctacatgtgagagagtgttttaagtcaactagagcgtcaacttataagaagctatggttggaaggaagtgaccctttctacatgtcagtcagtatcttctgaaacaactggcagacagtaggtgcttaatgaacatttgatgactgactcatagtgttatctatggttttattatgtaaaattatttcaagaatttccccaaatttaaattccaatgttgctaattcatcactgctatatctgtacagtactagaattacacacacaatgaaaagaatcctgggccagacgcagtggctcacacttgtgatcccagcactttgggaggctgaggcaggcggatcacctgaggtcagtctggccaacatggtgaaaaccatgtctctactaaaaatacacaaattagctgggtgtggtggcgcatgcctgtaatcacagctactcaggaggctgaggcatgagaatagcttgagcccaggaggtggaggctgcagtgaaccgagatcacaccactgcactccagcctgggagacagagcaagactttgtctcaaaaaaaaagaatagaaaaagaaaaaaaaagaaaagaattctggatgcacattatgattaagtggatctcagcaactgatgtcttctgagatgggttgtgaatatttaataacagggattattagaacaaactattgctttccttatgggggcagtagaattttgtttctttcaggaccattaaagagacagctgtgccagagaaaggactagtttatcccttcttttcaattccatcaggcctgttctgagccaaatccattccaatcagtttgactcattattcttcaagatggaaagctggatatttttacccaacatataggaatttcatgtgacttctcaaattcatacaaaacacttgcaaaagagaacagaattttttaagagaaacttttaaagctccttgcctctaacatcactttcttagctagccaatttcatgtagccaaggaggtaaatggatgtagctaagtaatttcctttcaataaattgaaataaagattccctaaagcttgctgtatactactagaagtcagaaaaagaagatgacactagaaatagtaaagtatcttcctatctgctacagattagaggcaaatataaatatgaccgctgccatctccccccaacaacagtgcaaaatattctggtacaaatatgtgaaggaaaaggctaacacatgcatatacaaaatgccatttgatagcattcgtgttacacccttgggaaggagattgctagccttgctgtccctaattcagttgtaaagaaattgtatataacgtttcaagttggttaagctggaattccatttccaagaatcccctgccctgtgtgattctggttgcgttggctaaaagaagagttttgaaggttgaagtgaagcagcaaccattcctctctgaaggttgtcacagttcaatgtggtgacagtcgcagagatgctggcaagttctggcttgatcttactctcctccaccctgcgtcttgctcttctttctacctgctttccccgtttaccaagcacggcccaagacccagcaccacaggcttgactgcagacccacagaggcaacagcctcggggcatttccctctctatgaaccttcccttcatgcttctcttgcatggctgggcacccttggcttctcagattgactggatggtgacttcccccatcttccaactttcccccagcgccttcatttccccagcctttcccacaactgtataaagtctgctagctgtaacaaatcccttctcccatggcttcatgtgccaaaggtcactgaggattactgaagcccagtttctctggacatcaaagttctcatttagaacaaagctgccatcaaagtgtctagctctgcattatgcaatagactgtgcccttgctaaaggtaaacttgatgtgactgcatttggatgtaacagccaaatatacactagcagtatacccatgagtaataggaacttcttgagaataacaatcccatctgagagaaaagctcatacacaatgaagccggctcaggaagcttagcctcattacaatgccgtgatttttaacttgtgtgggggtgttgctggtaaaattgagtagcaggcaccctgtatgggtgaaagctcagagaagttaattcaataaaagtcaagatggtatgaaattgctgatgaggggggacagaatgattttacagcatgtattttaaaaggccctaatgcttgtgatagtgtatgctcagatatctggattatttccttctttggaccactaccatcaactttgaagacaaccctcatttctcaatgtgcaggagctgtcttgccctgcccactccctccgtactcacctgtaaatgctgcctcctagaatagctgtgatcctgcctaagggcttttgtcaggcagcaggaacctttcacccacatgagcaaaacagaaatgctggagtgttcatgcccttggtggcatcactcaataacaataaggaatcagtggatacctacccgagtgtgtgccctagtctgtctccccaagctcttcagtgggtttgagctctagtagcctgcagtggtaatgcacgtgataatgcaccctgttttagctgctctcccttccctgtctcactttcccactcccgtgctgatatttcctgggatctgcctcctaataaaccacttgcatgtgagtctgtgtctccaagcctgcttctgagggattaaaactaatgccttctccatggctcttagccagggatgcttcttcctggctatttgttctcattaaggattcgtttaggttaaaatttgtattgggtaaaaagagaaggggaaggggctttgcaggtaaagcaaagatgtctgatgataaagtgtactatgatactaaattatagatttccctggaagcctccaaatgaattttgggtctcagagagagttatgagacccggaggatggtaggaaggggcctgtctctctctttctaagcccagtgagagggacttcaacaagactctttggggagcttgatatgcacctctacaggtggggagacacgatgttctggtgcctgccacctctctagagaagctgagagttagaggagagcaggcagcttgttgctctgaaggcagagcaagggcagatactgcagccttgggcttgccctgggtcctagtggtcacttgctaacataccttatatttgctgatgaagaatgggggagtgcttctagtggaaaggaatttggccttgtgcgtgagagagagagggagtgtgcatgttctcttagatcctgaaaataggtaaacagcctcaggagaaagaggctggagcaaatagctgcatttccaggtgttgagaaataggatggctgaatttaacaaaaatacaatatgcccagttaaatttaaattttagttgagcaatgatttgttttgaaagtataagtagatcccatgcactgactgggatgtacttacgtaaaaattattatttgttgttcaggtgaaattcaaatttacctagacatcctgtattttatctggcaactctgcttccaaaccgcctccatttcccagcaggactagaaggaaggttctgtaattgtgaaaatgaagtacttatcatgatacctgtaaaaaaaaaaaatccttggagtagaaagtgaaggttttgctgtgctcccgaactgagctaaagtgttaataaaaacttaatgctcaacttaattaattgttttttcttttaactaattaatctattgatcacatatttactgagtgaatactataggtcagacatagttccaagcactaggcacacaacagtgaacaaagcagatcaagttcttgacctcacagagctttgattctagtgatgtctgtacgtggcaatccgaatagaacttgggaccaaggaggcctgcagagttttgaagcaggtgatggttcctgccttagctcttgcaattcttgcctcctgcactggtgtccaaaactccccagggacaccatcaagaggaaaacctccattattgccagcactgctcggccttgctaagatctgtctgcagatgggatttggggacaatatgactgcagactgctcagctagacctggtgctatatatttccttcataccatacttcatttccaaagggattcgaagcagcaaactcatgcagctttatctgcttcactcactcattcattcgcttcattcagtcaaaaaagagatgagtaaggcatggctcccagctcacagggccatgaaccatgatacgctggagtaaaggaaggacaaggccctcaaagcaagaagctaccgactctgggaactgcaaattgcaatgtcatcatatatgatgctgtcaagaaaaaacaaattaaggagaaacaggaaatgcttcaactccctctcctataattcaattacaattttgcttcctgcttcttttcctaaccctttctaccacactctgtgagggtcatagaatgaaaacaaatataaatactgaattgcaaccacatgcagatagcacatgtaataaaagaagcctgcctatcatggaatttaacatgactggctggggggaatcaggctctttgtccttttaaacttggctcatattttaaatgacgttcctctgggtacatcatgttttagtctaaaagaaaagtatcaggccagtttgtatacacattcaaataaatatactttaccaggtaggtgtctgcattaacctagggaatgtatgagtgtgtgagtgtttagccagccacacatattgtgtgtatactcaccatgtgtgtatagaaaatgctacctgcatgggttgacaatttgatgtttcctaccttatgctaactattcccctttggccagttttttccccaacatcagtaatattattcagttattccctaaggggtgaaaattaagtgctattctgtgtgcagagtaggggaaattaaatctagctgcaacaagttggagctgctccataatccataatctgtagccatgatttgatttccaaaatttactgctggaaataaggttaatagtccccacatgttttcgttaagtctaaatttcacctcaattataggtgaggaaactgagactcagagaagctaaagcccccagtttaagtttgaagggctggttagtcacagtctctcgcaccagtgattgagtgactacagcctgctgccccctttttttagagggtgggtgtatacatcaaagcctgcatgtgttaaatacataggaggggaccaatctgagttggtacgtgaccccttcaccaaagtaggaactgagaaaatgaccttctccagctcacctctctagaaggaggggcactgatgatctttggagatgattttagaggcaaagctagaagctgcaaggccaccccagaaccaccaagcccagtggaacgtcagacggcatctgctcagatgctgatcttgtgtaattcataaatcactgagcctgttgactcggacttctgatgggctacataagcccaccaaggtatgttttaactctgctgtctttgcctttctaatatttcacattgaagttcttataatgcagaatctccctgaaacttctaatgggtttcattcttttgttgactcttcattcattcaggtaagtaacttcgcatttttcatttgtactggtatcagccatttcctaaacattttaatgttgctggttttgaataatagccactccacgcatagcaatctcaacctcccgctccactcaggcaaatgcagccatccatttacagatgtgcataggagctctttgcttatcagggctgccgttttcacaagatcccaagccttatagattccattacactccgcaaaacggcacacttggtctttgtgttgtatgcacttatgtccaagttttatgattattcaagagagtggtcgtggcataagaactctgaattaagcctgagtgatgctggcatgccagaggcaagtgtgagcacagatcttgacagccaaatagcacatcctgttccatatcacataaagttaagtgtgcacaccatatgaatagccacgtacattatcttatactgcagttcagagtagttggtaaacggaaaaaaaaagattctctgttttcctcatttctatgcatgatgacagatcttgacagtatcttggagggttgctaatttagtttcaggcagaaccatgcaattcctattgtctcagcatgactagaccacctcttcagatttcataatgggaaaataacacaatatctgcatttgttcttctggcagccagctagtggtgtgattgcattgttttctcaatcaagaagtaccattatttcagatagactggtacatggaagaagaaaaaaagtaccattgcttttgtcttcattgagttacatcaggatgattttctttggtagtgttatattagagaaagtaggcagggcgcggtggctcacgcctgtaatcccagcactttgggaggccgaggcgggcggatcacaaggtcaggagatcgagaccatcctgactaacacagtgaaaccccatctctactaaaaatacaaaaaattagccaggctcggtggcagcggctgtagtcccagctactccggaggctgaggcaggagaatggcgtgaacctgggaggcggagcttgcagtgagccaagatcgcgccactgcactctagcctgggcgacagagcgagactccgtctccaaaaaaaaaaaaaaaaagagaaagtaatttacagttttattttctctcatttaagcatctaacattattatatgcctaacagagtatatttatctcataaaagttgctgagaattcttttaaattaaatttactccgtagttgcattatattataaaataagagatgtattccagggaagaaagttttaagtaatacttttatattaatcaactgttgttgcataagaaacaaccacaaaaagtttattggcataaatcagtaaacattatttttcatccacacatctgtcatccagctgatgtggctctgctccaggcttgggggttgagtttaggtttgctccacattctggggcccagcttgggagtattctatccggtggctacctagggcagtgttctcatgttagaggtcggaagctcccagaggggaaagtgaaaacaagagctgctttcttttttttttttatttttaatttttatttttattttttgagatggagtctcgctctgtcacccaggctggagtacaatggtacgatctcagctcactgcaacttccgcctcctgggttcaagtgattctcctgcctcagcctctggagtagctgggattacaggcgcccaccacaacgcctggctaatttttttgtatttttagtagagacacggtttcaccatgttggccaggctggtctcgaactcccgacctcaggtgatctgcccacctcggcctcccaaactgctgggatggcaggtgtgagccactgcgcccagccaacaagagctgctgcttaagacctaagctcagaataggcccaatgttactgttgcctacattcgttcgccaaatcaagtcatacgacaaaaaccaacatcaatgacactaggaaaaatacttatcccatgattacaccttcagctttaaaagtgcagtgaactcggccaggagcagtggctcatgcctgtaaccccagcattttgggaggccgaggcgggtagattgactgagctagggagttcaaaaccagcctggccaacatggtgaaaccccatctctactaaaaatacaaaaaaattatgcaggcgtggtggtgggcacctgtaattccagctactcaggaggctgaggcaggagaatcgcttgaacccgcaaggcggaggttgcagtgagccaagactgcaccactgcactccatcctgggtgacagagagagactctgtctcgaaaaaaaaaaaaaaaggaataagtgcagcgaactacaggctcttatttaaatctaagttttaaattcgtgcaatatgaataacaatcatatactacagtcaaatttcaaaacaaaaaaaacacaaagaatggaaaaaaagtaaccagtttggcaggctgtttctcattttatcccatttcacattttatttcctattttatcttctaagagtcagaaacaaattccgataatgtagagaaagttcattagcaattttattaagaaatgcaactaatttttaagtgctgtgttaaaccaacaaatgctcaaattcatttacattaataagattacactattttaaattttcacaggcaaatgtattgaaatataatgtcatggcttaccctaatgcttattattatatgtataaagactttaaaaataattgattttgatattgtttgtattttgttttgttttgtttgtttgtttgtttgtttttgagatggagtctcactctgttgctcaggctggagtgcagtggtgcgatctaagctcactgcaacctttgtctcccaggttcgagtgattctcctgcctcagccaccagagtagctgggattacaggtgtgggccaccacacccggctaatttttgtatctttagtagagatggggtttcaccatgttgtctaggctggtctccaactcctgatctcaagtgatccacctgcctcagcctcccaaagtgctgggattacaggtgtgagccaccatgcccagcctgaaattaattattaagagctctttcagatgactatgtttttcaagctttgtataaacatggcatacacattgtatgtagatatattgatttatcaatttattgattggtgataaagattggatgggggtggggaatggttatgtgtgagaaaataatgtttgttaactactctctacaaattggttttataatacatattttacctaatgagaatgtggagtctcaaggaacacttgcccagagaatttcagttaacaaataataaatgtatctcattttgttcacatagataaaaccagtagtgaagcttatattcttctcatgcaccatactgctattctggttgacacagctgcaagaaggttaatttcgttcctctttttcttccttagcaatttttttaaataacaaaagttaaattttatctgggcatcttctcttttgagatacactggatggatatttctctgccacccagaggataaaagattataattttcttcagtcttctgataatatcatgcattttttcatatgcttttggggattgcagatggtcactgaataattgttattgtattattacatattttagaagtcataattgtaatgacttctaaaatatatcacatgactacttgtgattgacttcagcatacattgtatatagtttaaaaaatattctcaaaataccaattggtcatgattttgaaccattggtgtgcacagaacaaatgcagaaatgttttgtgaacaaatgatatagtttggatatttctcccctccaagtctcatatagaaatgtgaccccccgtgttggaggtgggggtctagtgggaggtgtttgggtcatgggagaagatccttcatgaatggtttggtgccctcctcatagtgttagttcatgtgagagctagttgtttaaaagagcctagcacctccttccctctctcttgctccctcatgccatgtgacatgctggctccccctttgccttccactatggttgtaagcttcctgaagcttcatcagaagctgagtagatatgggtgtgatgtttgtacagccagcagaactgtcagccaaatacacctgttttctttataaattacccagccttaggcattcctttatagcaataaaaaatggactgacacagaaaattgttactgagaagtggggcattgctgtaaagatacttgaagatgtgaaagtggctttgaaactggtaatgggcacagggttggaagagtttggaaggcttagaaaaagacaggaagacaagggaaagtttgcaacttcttagagacttgttaagtggttgtgaccaaaatgccaatagaaatatggacagtgaaggccaggctgactcagataaaaatgaggaagttattgggaactagtgtagagaacaaggtagtgctagtaccttgttgtgtactagcaaagggcttggctgcattgcatccacgtctgaggcctctgtggaaggtgaaacttaagagtgatgacttaggatatttggaagaagaaatctctaagcagcaaagcattcaagatgtggcatggctgcttctgaaaacctatacatagatatgggagcaaaaaaatgacttaaagttggaacttacaattcaatgagaagcagagcttaaaaatttggaaaattcacaacttgaccctgtggtagaaaaggaaaaagcattttcaggagagacattcaagtgggcttcagagcaaccacttgctagagagatttgcatgactgaaagggagccaagtgctaatattcaagacaatgaataaaaggccttgaaggcatttcagaactctaggctgcccttcccatcacaggcccagagacctagaaggaaggaaggaattgattagggggccaggcccaaggctccactttccttgcagcctcaggacactgctccctggatccacgctagcagtgctgtagcttcagctataagggccccaggtacagcttgggctgccactgtggagagcacaagccataagccttggtgagttccatgtgttgcgaagtctgcaagcatgcagaatgcaagagtgaaggaggcttggtagcttccacctacatttcagagactgtatgggaaagcgtgggtgcccaggcagtagcctgctacagaggcggagcccctgcagagagtctctactaggtcaatgtctaggggaaaatgtggggttggagctaccatacagaatccccactggggcactgcctagtggagctgtgggaaggggttgccaccctctagacaagagaatggtagagtcaccagcagcttgcaccttgagcctggaaaagccacaggcactcaactccaacctttgaaagcagtcacagagcacagaggctgcaccctacaaagctacaggggcagggcttcccaaggccttgggagcccacccctcacaccagtgtgcttaggatgaagagcctggagtcaaggattatgctggagctgtaagatttagtgtctgccctgctgttgcctcattcttttggctgattcctccctgtagtaatgggattgtttacccaatgccagttctaccattgtatcttggaagtaaataacttatttttgattttacacgttcctaggtagaaggaacttgccatgggtttcagatgagggtttggacttttgagttaatgctggaatgagttaagactttggggaactactgggaagggatggttgtattttacagtgtgagaaggacatgaaatttgggggatcaggggtagaatgatatggcctggatatctgtcctctccaaatctcatgttgaaatgtaatcctcaattttggaggcaaggtctagtggggagtgtttagctcttagggagcagatccctcatgaatggcttggtgtcctccccatagtttcagttcatgcaagagttacttgtttaaaagagcctggcacctcctccgctctcttttgctccttctcatcatgtgacacactggctccccctttgccttctatcatgattacaagcttcctgcagcctcaccagaagctgaatggatcgtggtaccatgcttgcacagctgcagaaccatgagccaaagaaaccttttctttataagttacccagtctcaggtattcctttatggcaactcaaaacagattaacaccaaaaaggaatggagacatctacccgcttttcactagggtaaacttgaatacctttgttttgttttgtttttggaaaaaaaaaaaaacccaaaaaagtcttaaattattacgaatagcaaaaattagtgatcagcaagcaaccaacttgtggttaagtaataaaatttgtaagactattatagccaggaattctgtttttgaaaaatgactttaacaatgggctttggctctattttgaatcttaaagaggataagaaatatgagctcccaatatacaatggaatttaaatacaacaattgtggaagttttgtacagttgttgatggattacccacagctgacatgcttttacttggtcagaagataaaaagaatagaaacatttaggccattcgtgtgttgttaaagcaagttggaattcaagaagacatctgattccactaaatcagcgaggagttttcaaaaagcagatggcattttaagccaaaagacagtcctttgaaggatcttgagacatgtaatttatctgaatacatgttgctctcatctgtgatttcctggaggataggaactatgtcagattcatgccttccttccctagctcagtgactggaaagcagaggggctcaataaatgtcttaagagaaaagagaggagaaaattttgtaatgctatttgaaactttatgcaaaatatttgctcaagtatttcacactcagtactttttactttttgcctatatgcatactaaagtacaaataaattattgctgattgtgttgattttgcccattaaatttgcattgtatttattttaaacaagtctatgtttttagacattaagataaaaatgctaccttatagaaaaacaatgaacagtgctgtaaattaaaattagcaccttagaaacaaaactaaatagatttcagggtttgttgttctgaagtaaattctgtgctgcaaattttgaatcctaaaattcagaacataatttttaggctccataaaacatgtttgtggttggctgctttatagtaacatatttttgtatgcatttggcttcatttcttctattattgtgattctcattccacttgttacctagcagttgccttttctactgtttaaaaaattttttaagggggaaatgtgttttgtaactcagaaaaacataatgtaagatttctcaaaatatatgattttaaaacaaggacaataaatgatttcctcttaaaactgacattacttaaattactaacacaataatatctttaaatgtctacatacatgttaaatggattgtaatgtcttttgaaaaatatttacatattttgtttcagagactaagtatactcaatttatctacaatgattcctttgttgacaaatagttacaggcgtgactgatttgatagttcattggaagaagatcttcggtatctttcataaagcttagaattggcctggtatttaaaaaataattcatgttggagtaatttttgtatggttaatccatttaaagacagacaggataattcatttttcactgaatcatctagatagtagaggcctataattgatgatggcaagaataagaatatttaacctttgggtgaaccaaatgaataaaactctttgcaacaattcttatgggtagaaacagtatttttctgactctagtttagtatcttgggcttcttcccaactgtgagcttatggagaaatgattcctctaaggcagaatattacttaggttattgtcctattatttctttcctttccatcaattacttccagtctagcagcttttagcaagattcttgtttgaggttagccatcctgctatataatctggagtctaggaaaagtacatgtcattttacctggatattttactcaatattaaacatttatgttctaagtttgaatatccccctttccacatctaaaaaagaataaatcaaatagtaaaccccattgctataatttgaatgtgtcccccaaagtttgtgtgttgaaaacttgatccccaaagcagtggtgttggaagatggggcctaataaaaggtgtttgggtcatgggggcaccatcctcatgaataggttaatgtccttatcttataagtgggtttgttagcatgagaattggttcatcttctcttgcatactctctcttgccctttctttgcccttctgccatgggatgataatatcaagaaggcctctaccagaagctagcaccttgatattggactttccagcctctagaactgtgagaaatgaactttttaaaattataaattccccagtctctgctattgtgttatagcagcaaaaaaatggactaagatacccatgaaggagaagtgataataaagacaagcttaaagctatctatatttgaagactcttgaaaaactatgaatatgtctccaactactatcaaagatgttagttagaatatagattataaaaaaatcccatacctcaaccattctcactactagaaacacatattactaaaaccctgtggcctgccaattgtaaggtaatcttttaacataagaaactgcattaattttctataaacccaaagacttgcacaattatttcagaagtgtaattctcccaacacacacacacacacacacacacacacacacacacacacacacgtaccacatttcttttcagtagcttgactataacttggaaaaaatgctttagagaaatcacttcaggatggtggaaaaaacaaagaatcataattctccttatgtgtaatcaatagtaacactccatctcatgtataagtttcatatactttcaagtccagctctctggctttgttcatttcattcaacaggactgaaacaaaggtcttggcctcagtttttcacatgaagatgtttgcaaaggaaacagtattttaaagagtatttaattcacagaagctgactataaaaaataactaagaagcttcttttcttccaagacttagtgtttcccttgttaatgagacatttgtcatatagacttgtttactgccttgttcagtttcatagaaaaaaatgatgtacttttagaatttgatatagaaaatattaccagaaaaattataacaaatggcatgtttagaatttatagtctgctgaaatacaatttaggtctttattttactatgaaaatgcaatcaatagccaaaatccaacgtattccagtgattgaagtttatttgaatactgtgaagttgtgaaatacatatttggtcttccctctgtgtctttctataagctaatgagttagctggtgactggcagcccctaggtagcttaaggatgggggctggtcacagaaaaggccaaagaaggcatgattagagggttgagacttttcagccccatcctcaacctctggggagtgtagaggggctgaaggttgagttgatcaacagtggccaataatttaatcaatcatgcgtacctaatgaagcttgtataaaaacctgaaaagactgggttcagggagcttccagatagctgaacacctgaagacgactggagggtacccccctggaaggggcttggaagattggctcctcccatacttattcattccttatccgtatcttttgtaatgtcctataaattgcacccgaggaggaggttgtgggaacctcgatttagagctggtggtcagaagcacaggtaaaataacttgtgctttcaacttacatttgaagccagggggacagtcttgtgggactgaaacctgaacctgtggtatctggcactatctccaggtagaaagtatcagaactgagttagaggacacatagctggtatccactgcagaattgattgcttgcttggtgtggaatgaaaatgcaatgtattggaagcccctctctcccccatatctgatgtcagaagcgttctgtgtgatgtgatgtggtgggtagagaatagaaaacacacacttcagtttttactatatccttccacgtatttactgacagcaggcattcatatggaatgtcaggcactgcaagcgatacacacatccataagacagcatctcttccattaagaatcttaccaactcacaaaagaaaagagatatgaatacatggaaaggtaaatggcaatagagtatttaaataagtaagtagaatttgaatttgtctttgataatggtgaggaggtgaaaggagttcttgaaagtctggaacaaaaatcaaatcaacttatgagtggatagaagatgggtaggtaatgctaaagccagtatagtaacatatgttaagtgtagactctaggtgggttcattgtaaaattatttcagcttttctgtatgtttgaaattttcattaaaaaatgatgaaaaaagacgagcatataaagggagagaagtaaactactttgatgggcatttaatttgatgtaatggaaaataaaatacgaaaggtaagttctaggaataattgtattttattagttctctgcttcatttggtcagaaaactaaaggcatttaatgttagagaataaattacattgtgtatctatcagctaataatagaatttccaactcaaattggcttatgtataaggaaagttattatcgtgcctaacaggaaaaccaaaattaggacagacttcagggctgtttaaatcagttccttgtaaattctctgaggggtgtaagcaccctctctgctgtctataacatcatcttcaatatgaggctagtttctatccactcaaaagatggctgacagcagtcttctctctttccattgcaaaaaaatgactgccttcattttcccagttgccctgagtaaactcctccttgtgtctttctgtcctaaattgatttaaacctgcccagttctgaatcaagctctggtaagagggtgaggaaatacaggctcatgactggcttagactcgtcatggcagggggcagcaacacagtgaccactgcagggtagagaagagacaaagacaccctccatgagcgctgaaggataaagggtgggggaaaggcatttgttcgtaaaaagtgtaaaccaggtacttttaggaaaattttaggggaagaatatgttataaaagagaattatctttatgacagtaacttttttcaatgattataaaggcgatatgtgttaactatcaaaacttcataaaaggcgatcagttataaccttataatcaaggtttatgttgacatttccttcaaacatttattatgtgtgtctgtgtgaataaatatatatgttatatacttgttatgatactgcctatacaattttgtgttccacttgctttccttaccattatatcaccaatatttttaatgtccttgtaatgtatttacaaattttgtttaaatggctgcatatctttccattacagaaaagtacttcatttgggtaaatattcttatacgatacaatatttaaaataaatcaatttctgctttgttattaacactggtataaatatctttataataaaacattgtctgaatctctgattatttccttagaaaagattttcaattagtatatcattaagccaaactgtatgaatagttttaatctcaatacatattgtcaaattaagcttgtcacattttatacttataattgagtgatgattccatggtttctaagtattactgttattatcattactattatttagcaactcccttttggcaggaacaatatgctttctcacttttcagctccaaggaggtctgtaggagatatagctacaaatatgttttctgtcacttttgttcttcattaccatcttgctgcatttcttccttcttctttggcattcttacatttaaaaagtagagatggggacatgtctctgttatttcttcttttatttatttctaaatctatttcttgttatttcttgatctaatatccatacaggtttaggatgtaagcatttaaactttcatacgtagaactccacatagcaatgaaggaagaaatcaaagagtaaatgaatgaattagtgaatgaatgcaatgaatgagaatgcaatatctggtagttcagaatgaaattttccttatcaagtccataaaatttgcaaattacttcataaaagtgctttataggttttggcattttaacaatgtttacagtgttttagaagagacaaaagatttcagtcttgtggcagttagccagaatagggagcaaatgtgcatgtaattgcactattaagttattaagggtggtaagaaatttacacaaaacagaccctgaattgttttaaattctgttagttgaaaggttaacaaaggagaaattatattctttaactcctttttttgtttgtttgtttttaattcacctttattttccacttggccacattattttcttgttaaataaagaagagttatgaattttcttaatgagttaataatgtaagctgaatgtccacaggtaaagggtcttatgtttcaagttcatgacattaggcgacaaaaatcagtatatccaagtatgaatgagtagggaaaaaaagttatttcatttctggaaccatatttttagttccaggatgtaacactgtaggagataatatatgtgaaagcgtcttgaaattgtaaagcactatctaaatgtaaaggattagtattagtagtgtggtaaatcatttttctgaaggttggtttggaccatttatattttcaaagtagatgaatagaagaaaaatatgttttactccaagaatggctgatttcctcctctagagtagttgtagcacttttcctggtttgatttgattaatccttatgccttcctggtgaggaagattggaggctcacgttgcatttttatggatcttgcctacattaagtttcagatatatagatgccatttcttaccagtgcagctgactcgtctgtcttttaattatttcttttatcactgaatttcagatggacacactagagggaccatagcagggagcccactgcagcggcagcagttgctgcagcgtttggaagtgttgatatggcttctggaggtttttcctgatgctttgagctgggctgggggagggggaggcattctcagaaagctcacaggactcaatgcggggaaagggccactggaaaaggagctacccaagccattactcttcagctttcactgagtgtttatatgccttggttttatttcagaaaactaattatggaacattccagcattcttcataaaaagtgagcttggggagtttatcgggtcctggggagtcataagaaaaggatcaatccaagaggtggagcagaaaacaatcaggggacttggagtttgccagctggaaaaaaagttaaaagcggccaaagagccctggaagataatagaagctatattcagattcccaagttgtattctgagtttttgctccttggaatatccatagtcctccatttcagtttccaaagtaccccttctcctaagaactcaagaggctacccaatttttctcacaatgtccatacagagaagggggatgaaaggccaggtattgttatttcaatgtcaggcacacacagaaactcaggcataggaaagtaaactgctcaggatgacaaagtgttgttaggtgatataggcttcaattttattttttactcttcaaaaacttttatttggtcaagtgatatttgagagagatataaaaaaaatcttctttataaaaatgtcagtgccttccaggccatgtgtattcttccctgttttaggaattatcaggaactattgggaacaactgaggcctcttggtcactagttacatacctcctttgaacaatctcttccttcactttctttttttttttttctgcaatcttcgactcctgggttcaagcgattctcctgtctcagcctctcgagtagctgggactacaggccctgccactatgcccagctaatttttatatttttagtagagtcaggattttgtcatattggtcaggctggtcacagactcctgacctcaggtgatccacctggcttagcctcccaaaatgctgggattataggcatgagccaccatgcctggcctcttccttcactttcttacagtgaggcctggctgtctccaaaggatttgctctccctgcagccttctcatccagttctgttcatttttcctgtacaccatgcaccatgggtcctagatgaaagaaagatgacctccttgttcataaaaatcatttgcagactatttttccttctcttctagaaagaaaaaaagaatcaacttctttgaaatgtatgtttacttgtatgtcctcagattatcccatctagagttaacattttttctcctggttgcttcctctcagttacagggaattttagcattttttcccccatgactactttcttaattcttggtggctccagcaaagaatggaaggttcttggctggtccatccatcacctaagccccccagttccttgactttctctccttcacttctcttctggtctacccatcctcactcactccctgcacagtcatactctttttgatcttgccattgcaataattgcaccagctccataatgttagttttgagcatcccgttctttgactactacttcttatctttgcagctccttccctgaatccaagaagccattaatcccacacacatctccacacttgagcctactatattccaccattcatcctccccttaacattcacacctccctggcatggagttcacaagccactgtgatgatctctccagaacacacaccctcaactcccttgactccctcaaagtcacctagaaaaaactcaccaccagttaagtcctcctttctgcctgctctccacctatttccaggcagttgaacatgactggggaaaagctcacaaccacactctggtctcaagtgggtcctcagcctcctagaaagtctcttcacattccctcagttaagccagtccctcatcactaagaaaaccacttcctcagtcattaacatcattagcatcaactccaatctacttgttttcaactttccccagagaaaatagaagctatcaccagagaactttgtcttcaaactactaaatctaccaacctgcctgcttctttatcccatacacttaccctggatccctggccctcactcacttgatgtttgcttctgccttagccatattttttcttttctcttgactctaatgccttccatcttcaaaacagaacagccaaataaataaataaataaataaataaataaataaataaataaataacatcctctctcctgtgtcccctcttcagctactcttccaggcttttagagcagaactcctcaaaagacatgtctttgtgatctctccacttcctcacaaccattgtctctcaaactcacaagtctactgcaaaacacacttgttaaagtcaatgttaaagtcagcgatgagttccctcttaccaaatacactggtcagtttcctgatcagtatatgtatcttaatatgcactgccgcagcatctgacataatggtcacatcttcctttccgaaacaccttgttcctttgcccttggacatccttcactcttattttctcttactttattagctccttcctcctactctctttttctggttccttttgaacactggagttttccagggctcagttcttggaccctttttcttctgtatcttcgcttaatgtctttaagtgacattaaccaggtctgttccactttatggtttatttgctgaggaattcagctcctaccttttccctgtgttccagactcattcatgcacttgtctgtttagtgtttttgcctggaaatctaataggcatcataagcataacatgttcgaaaagaactatgagtgtccaaaattcaccattccccattctcttcttaaaaattagtatcctctttaacttagttgctcaaagcctaaaaccttagctttatgctttacttttctccctctgtctcttcctctgtatctcttctttctcgccttttctccctctctcttgctgtcttattctccacatccactccacgagtaaatcttgcttactctaccttcaaatatatcactttaaaattatttattgtttatctactccactagaacataagctcccagaggccaggagctttttgtcttatttgctactgtttcttcaagcatttagaatgagaattggcagactatgacccatcagccaaatccaggctttcactgaatggtttttacatctttacatggttaaaacattaaaaaataaaataaaattttgtaataaaaaaattaaatgaaattcaaatttcagtatccagaaataaagttttattggaacacagccatgctcatttgtttacatgttgtctatagctattttgtcattacaacaactgagttgagtagttctgacagagatttttatgggatgcaaagctgaaaatattcacaatctggcactttgtagaaaaaagcttggcagtttctaccgtggattaacattccttcacagaagctgaagcttaaatttattttttctgctagttccaataatgaattcagaactcagtcttgtatccatgaaccacatggctattcttgaaccaacccctgatgaagtgttagaccacagttaattgtataaatctgggtccatgcccatctctaaagctggggaatggagaaggattaacactctctatatcatatgggcttaatatggaagagaggcagtttcccaagggaagttgacacgctataaccaagaggggtgagtagagaccacccctctgataggaaaaacaaaacacttgttttctacatggaccttcctgctattttttaaaaaatggcacattccaaaactcttaatcctatcaggaattaaaattttttgttactaagttatacatacttagtttactagaatgtaatacttggtaccttaaaccatctgtatcttggataggatctttgttttcttaaatccatggactccaaacatatataactattactttttgaagctaattgtgctggaatgggacatagtccaggaggtatgaaaatggatgtcatgcctgggaggcgtggaccaatttatagatgtcctaggcaggagccaggctactggtaccacatgtacactcagcttcttggcaatgacagaatgagatctctgcatgttgtacctcattccagctctctttcctcattgtgagaattaaggaccacccagccagagtgggaggttatctgctacaagtccttactaatttatcagacaaaccaattcaaggtatcagaattcatggagaagaggagaggacagatttctgactaaaccgtgtgtctgaatctccccctcaataaagggaagccattggagatcattaagaaacaaacaaaaacttttatatggtcagattgtgttttagcaagcttattggcggtagtttggaggctgtgtcatagaggaaaaagataatatagaatggattgtggccattggtaattctcctaactcaataacttcttagtctcgtattcttgaagtcatggagaaatccttgagtcagtgaaatgttcctttatcacaatgtcacactgcaagaggtttttttttttttttttttttttcctaagctgaagatagaactgttttggaaatcatagaaacatatttgcaacatgcaagatgttatttctgcattgatcattttaattcaagaaattagtttgggaattagacttcaatagtcttgtgattcacccttttgaaattaatgaagatttacaattttgagttcctctttgctagcattttcccctttgaatagcaatgctttgttcataattgtgacatttcttttctgttcgcattctctcactgagaattctctttgatagggtggattttctgcaatagaaataacatttttgtgcaactaaaaaaaagccaaatgccaaagggtaaaaaataagtttttgtggttataagattgttaaatgtagatgtaaaattatgttatttctgatgtcccatccaattgtggcataagcctgaagtttcgttcaccctgagatctcttattatcagccttttctggggtgaggtctagctcacacagaatccccagtgtaagggctgtgatgttattttaaacatttcattaatttaaaactgtcatttaacaatggcctctagttctaccaatggacttccttgtgggtttctgacaaaggtcgtggtctgtggtccctctccacacctaattgtgatgaccttctgagaataatgactgctgcttcacatctaccttcccagctttgtgaatctctggggttggccagctgtcacttagaatcatacaaggaaagggattctgcaagatgtaggcccagcttaaccaagcagacacacaccctattttcttctttcactaaaaccaatcattccctattttattctttaaacaaaggactactcgacaatgctattaattttcagcataattaattacgcctaaaagtaaattatactcttcctttaggggttgcttatttgtcacaacttgcccctggcaagtctgcatcttgtcaactagcagtttgtactcttgtcttctttttctcttgcctttaaataggaactataatcagtttattttccctccacatcaacaataattttttttttttacttaattttcttagaaaattctaggctggcatgtaaaatgtaatggttggtattagagcaaagcatgtagcacaatgaaacgccatctttaataaaggcatatgtgcctttattaaaggtttctccaaggtttctgttacaggaaatcatacatcatgggtggctagaggagaggcatcactgtctatgggagtcattggagcagaaacagatttatttcatattcttcctttgactattcaaacatagaccaccagatttatgaaatcctatgttctgtatctctgtatcttcctttcccctgatgtcatttatttgaaccacagcacaaaatgagattgagtaggcaaaggccattaaattcaatgtcattataggaggtgcaaggggaagcttggattcttatgagcacattctccacaagtagaaaccttaagaagcaacactaggttttttttttttgttttttttttttaatgaagttttgctctttttgcccatcctggagtgcagtggcgcgatctggactcactgcaacctctgcctcccgggttcaagtgattctcctgcctcagcttcccaagtagctggaattaacaggtgtgcatcaccattcccggctaaatttttgtatttttaatagagatggggtttcaccatattggccatgctggtctcgaagtcctgacctcatgtgatctgcccacctcagcatcccaaagtgctgggattacagacgtgagccaccacacccggccaactagtttttcttaccatctctcttgcttttcctcttcaccatgagatcaccatagccatgtggagcagagtcttggctgacccatggccaccaacatacaacatgagtgagaaagaagtcaaggctatttttattttgtaagccactgaaatgtggagtctgttatcacagtaaaagctaattaatatggaagttagaaataaattgcaccaaactgctaacagtgactctttctgtcatgttgaggagattagaggttactatgatttttcttactttgtttgtattttccctgttactgtattatgaataattttagatgtggaaaaaagttatttttttcttttaagcatacattcagttcttccttggcaacagacatttgaaatgtaattaaatttggactattcttgaacaaaggtgtttgccatactcagggcaaacttgtaatgctgcattaaaacatatatgtccttcaaattgacctacagattcaatgcaatacttttcaaaatcctgctggctttggagaaattaataagctaatcctaaaattcatatggaaactcaggggacctagaatagcttaaaacaatcttgagaaagaagaacaaagttgtaggactcacacttcctgatctcaaagttacagtaatcaagatactgtggtactaatatagaatcaaaatataaatcaatagaatataactgagactccctgagtaaatcctcacataatggtccattgtttttcaacaagaatgccaaaacaattcagtagaggaaagaatgctgctagaatgactgggtatcctcaaggaaaagaatgaagttggaccctctatctcacatcatatataaaaattaacacaaaatgaattcaagacctaaatgtaagagccaaaactgtaaaactggattagaagagaatttagggatgcattttcatgaccttggtttaaggcaatagtttcttggatatgaaacaacaagcacaagcaagaaaagaaaaaacatagataaattgaacttcatcaaaattaaaaacttttgtgcttcaaaggacacaagaaaatgaagagctggcccacagaaggagagaaaatatttgaaaatgatatgtatgataagggtctcatacctagcatacataaagaacttttacaagtcaataatagaaagacaaagagctcagtttaatcatgagggggacatggatggtaggatgtaagtatatacaaggggaaactgacatgtctttaggaagttagatatctattaaaaggactagcataatacttgtatatcccttgtttggaaatgtgatattcttattgattcctttggtctacactgatcaccacttttcaatatattagaatattgcaaaaatcacaccactaacatgattcaaaacaaactcctatgtattgagtcgataatatattcaaagcattatattggaccttgcagaatttaaagatgaataacacacacacacacaacacacacacacacacacacacacacacacacacacacagattttttcttgaagtaatgtttagttcacagaatccattcctcaggccacccatatcaacactgcttgaaacttaacaagtacattctcaggacccacccacccaccaaccagatctactgaattagaacctcgctctggtgaggtggggttgagggagtcccagcaatacacgtcccacatcttgttaagtcctccaggtgattctgatgcatgttaacatctgagaaccactgggttaagagatgaagaattaaaaaaattattcaagctcatatactacaagacagaatacagtaaatggcctaaaataggtacaaagtattgcatttcgtggctaacttgcaaattgtaactagtttaaaaaatgatttgttattgaatacacactatgtatgttatcttttgctaagttttatgaaaagcattttgttttgaataaaatttcttcccatctctagaatagagccgtgattatgaactaagtagggaagaaggaggaatatcagaatcaactaagggtctttatcagattacctgagtctccctctactctggccccaatcccctgttgaaaaccacagttctagatggtcacaatggagaatcttaaatattcagaatgttactttgatcagattatttttggataccagctaatccagtgatcatcattttgattctttattttacctaccctttagtctgttcactaacatttgattgctgctctgagtctttaatttaaaacaaacacatgaagtatcttgtagggcttatggaagaggtgaaatcagagtgaagtgacagtcaagttttccttctaactgtgacacacactagtataacgttgtacaggccacttaacatttctgatgaggcttaatttcattatctctaatattagttcaagatcccccgcttactttacaggatattgagaggactaaaggagataatatttgtgaggttatatagcacatattaggccctttaagattagcaatgatggtccttccatatttttctagagatgtccttctcctgaattcctgacctatcagtggatatccatgatgtagaaaatacttccaaaacatttttactctttgataccataattgtagggaaaatctatttaattatctataccaatacctatcatctatttatgtatctttattatctctcttatttatctttctatttctctatcaattatctatcagttaaatggaagcagacacttttatattgagaatgtatagctatcgggactctattcaattaacagaattaaattgatattgacaggcttaaagacaattcaaataactaaggaaatattgacaaaaaagaatgactaaggagagggaaaaatttgccttaccaaatattaaaacttctttcaaagctactataatctaaataccatggtattagcacactagtacacacatcagtggaacaaaatacagaattcaggcatagacccaagtttgcatggaaatataatatataatgaaagacatttcaattaactgcaattaactgtggtaagaatgttttatttaataaatggagctgacagaataaactatccatttggaaggagagcagagctatgtcttgcctcatatcagagatggattaaatacctaaattgtaatggattaaatatttaaatgtaaaacataaaagtaaaacttggactgtttgtttaactttgcggtaggagaggacttattaagaaagacattgattaaaaaggtgcgatacatatttgactgtttaaaaattaaaatttttcatggcaaatgtcaatataaacaaaattaaaagacaaatatgagtgggaaaaatatgttaccaatttgaaagaattagtctgtaatatagaaaaagttctcacaaatttgtaaagacaatgagcaaggatatcttttctaggtaatatacagaagaaaaaaattttaaatggtcaataaacatataaagatatgtttaacctttctagtaaagcaaattcaaataaaaacaataatgaaattgtgttcttcattcataaattgggaaaaaattaaaatattgatttttttcacatgccaggtaacatgtagggaaatgatcattgtcatgcatttttaaagggaaagtgaattgttttaaaacattgcaaattaatcagataatagtaaaataaaataatgccagtgctcatttgcataacactcacactttggagaatttatcctacaaaaatcagtttgcaatatatgaggatcaaaatgcaagagtgcctcttttggcatcatatataatggcaataacctggaaacaatctgagtgtcttttggtaagagaatggctgaatcaaatatgggacatccatcctatggattatgattaagctgtccaaagcaatgaaatagatcagcatctgctgacttgaaagaataaccattaaaacatatatactatattttatatatatatatatatatatatatatatatatatatatatatatatatatataatattttgtgtgtgtgtgtgtgttgctttaaagtcaggcaaagctactgagaaatgtgaggttatttcataattgtgaaaaaattaactgctggatatgtgtatagatgtatctgtgaatcgatgaataaggaagaaaaagtgagaggatacaaataaggaaatgaacatcacttatacatttacatggggacttgactggaagagagttgctggggatgatgaattttttgattagacatctttgatttgtttcacatgtcataaatatataataactctaacttaaaaatataataaagacaggactcaggttaggtgtaatcttctatgtatgtgcacagtacaggtctggaagggccatgccaaattgccaattttagaacctcttaggaggagagtggtattaggaaaagagggtaaaagagagtaagctttttcttgtacatatttctgtatttattaatgactgttattttacaatgagtacctattcaggtattgctcatgtgatttaaaaataaataattgttttcacccaagctttaaatagttgtttacacccaagcagtagagtaggacagttttttttctcccttcagtagacaacagttattggcacaaacattagcaagcataatggttgtaatttggttgaagaagataatcatgtattagcttaagtaaaatgcaatgccttgcaaagatctgtcattctatgaaagtattgacttagagtagtcccaactaggaaatacaaggcgtaatccacagattcttgtgcaattcagctgtattatctcttatagctcctataaaccttaacactaattaaggatctttaagaggtttttaactagagggatgggagaaagggtgtctttatccccacttaggcagaagaaatgttttaaagtggaaaatgagcaattgatggttgccttgccaagtataattaagaaaattcagcagcactgattgtaccaagttctggaagtaaaatctgccagaggctgagatttggcctttatgtaatactaatactgtaaactcaacatgtcaactcttttatctgattttaattcttggaataagctataatctctcacgtatagcataatgtattttatgcccatggcccaaagcaaaaggtctccttttgcttccctccctcctacattatctgggaacttggtgtcaactcctttacgctctgtacctccctttgcccttgagtcctgctgccacactgaaggcctgccttcttctcagctgttcactaacttcttttactgcacagtttgctggttgtgatttcttatttttttcaagaggattgagagacttagaaaagcttctaggacccagagaaggaagctgtagtggctaaacttcacagacatcatgactggcaagaagtatctggctcataggaagttcttgccttcagggatataggagttttcttgcaaatgtaaaccctgaatagtttgaaaaattatgtagccatatgaaacaagagcataagccatgtgtgatagggctacgtaggatcagctttcagaggagtagtttagatcagtgtgtgctgagatgtttgagagagaataaaaatcacacaggatttggtctgttgcactgctggagaaaattaggagatgatatttatgtataaattctcaaagatatatgttgacctgctacagcagtaatatatgctaggacatataatatcactttggatagataaatgtacatatatatatatatgtgagggcaggaatgaattgttcaatggtattggtgataggtttagggttaagaatgctaattaacttatttttaccatacactggatgcaactatctctttcttccatggcactacactcttgtttgatataatttatctttcccaaagatggtgatcattttctttgatattcagcccaatgcactgaaatattgtttgcccagagcctatgttttcttctaccttcctcactgcttacaagaacaaaaggtacactacaaatctaatttcatgcaattggcctatttatgagccacataaatgtggcacaaacacatttaccgagaactataattttaagaattaagtccctctgggggaagaagaagagaggtagaattatatgcatgaatggggctgaaagagctgttcaaagtttggtgatgagtgggcaaactcaggagagctgagtacccttggtaagttaaaaaagtaagtcagtattcaagagactaggaagaacatgaaagaagcccatgcaggagaataagcagtgagataaactgagttttggagacacagaaatgtccttggaacccaggaatacaaagcctggtgaagtggacggagattctagggatactttctgtgccccatccataccctttcagatattatcattgtcatataagtggctgacttccccctgccatcatgttcattacttggcctaagggctttctctaatcaatggagtccacctagacctagcataatgaagaaatagagaaaatacaagtattgaccttccctccccacccacctccccaactatagcatccttcaaccaaggatgaggtgtaaatgcctcaacttcctccttgggtgagataacactggatcctagcaatccgaattgcaattaatctgcagttatctacagtactaacacctagtaacacattcaacattgacttatcttcctttccccactttaccattgcctctctggtatggtctgggatcccctccccaaaaacctagctacataaatctagatttgttccaaatcttactttgggggaatccaaactaagatggggatatgtatacaaaaaggttagggaaggacttaaaaaataaaaccaaacaaaaaaaaaatgaaaaataaaagtttttatgtgatccaactaggacagttaagataaatgaatgaaaatattttttttttcctttaactaaaactgtttaaaaaagagtttaggaaacattgttatttaccgattttctggattagtgttttgtgaaggaaagggaaacatcatgggcacttttttaaagtaagcttctgcaaactgtaatgctttaaaccaaaccgcatgttaactggaataatgggaacccacgtcactaagagacccattgcctggttctctgtggtttcttaccacagtagttgtttttgaaaataggtggtctttttcaaagagcacttatgttatgtgttgaaataatgaaaaagcttctgaaacacaatatgcattttttaatctagtaataaagaaagtaatgtggctgaataatgcctggctagattagttttgacactgtatttgctttgtgttcaactttatctggcaatgcattattcactagtactatacacagtgctttattaagtcttaatcaaatgcattttatcataagtgtcaattcagtgctttgccattgtatttatatgtttttaaatactgagttctttgtaagtgaacgacaaatacttaggctggaaaataagattgtatttctggtgcttgggaatgaggtcattgtgtatgcacagagtggctttacattcacactaaagtcatttggaaacagattatattgccgtttcttttttctcctaataaaatgaaatgtaattttcttcaccaatgtgaaagctaagctggtttgaccaattgtggccatttaaataggtttgtagagcaaatagatataaattaaaacttttgctagtagatttttatttaatagattttggactaaattttcaaatgtgggttaacaataaaaatttatgcacaaactgacaagtgattacaggtacacacattttcaaatataattaataatatgtttaagtataataaaactataataaatttttataaagtattcattaaataattttattataattaaatattttcattataattaaaatttatatatttataacattttaaaataatttataattataacaaaatgttataaatacaagctggccttggaaagcttcttaggttttttttattttctaggaaggaaatgcttacaaaatatactattaagttaagatcttagacttactcttctgataatattggaaaacttcagtttaaaaagtattgtacaaatccaacttcaagtttcttgatatttcttttatcaaaacagcagctatagatttgtaaaagttctagtatttggagaaaaaatataaatattataaccctacaacattagtttggagaaatctgtttattccacaggtaaatgtatctgtaagactaacaaaattcataatttttgatttaaaaaatcagcacataaaaataattgcagggctttaaatgagcacagcattaagttgggctgctgtctctctccgaataagtgctaagtgaagcaggaatgttttaatggcatgaggccctacacaccaaaatggcattagcctctgagtaaatatcactagttggatagagttttattctacaaagtaaatacttaggaaattaaatattaattagtacttacatgtgcaatactaagaataaagtagaatcttctttaccctaaaacaatatcccaccatgccacataaatgacactgaagtgattatttgtaaaaacaaaagcgaaataaaattatgataatctccccaaattatctccccaccaaagattattgattttatttatttatgattttattttagaaaatcgtggtttgtataaaagggtcccaggtatatctggatgttttgataggagtttagggaatcctagaggcttccacgcagaatggattccatgaccatttttccatgaaaccatttgaaaccactaatgattggtgggccggggtccttttccattgtccttttgtgatatcttgcactttttcatttttattttttcttctttctcatttctttgctccaatgtttaaatattcctgccttgttagcgtgtttcattttcttggcctatgaactgctctactcataggtaaagcttggtccgttgtgaaaaggcctcagtaactttttaggtttgttctgatggattaataaatatgtttaagcttttgagattagtatttatttatttaaaaaagctacctcactaattttgaggaacactgaattaaattcaaagttttctttattatgaaaattctcagaacctttaatattcattctaatattcattctgatgacatatacttctaagagagggatataggatacaattatttctgcatcttatttgcccacagaaccccttttgtgtgggtagagggagcaatggaaaacttttatagtacttagtctgtgtcagacactgttctaagtgctttaccttatgaggagaaaaggaaaaaacttttttacagatgcagaaattgtgtcgagggaagctcagtgccttgccctctgtcaacagccaccaagggatagagccagcttatcacctgggcttctttaggattgtccattgaagggttggtcaaacatggttgtctggtccaatctttctgttgaccatttagttagtgagtatcgtatatgtcaaaatgaattcacattaattcttgatgcagacacagccataacaaataaatcacttcctttagactttaactttcagctgaagtgtcagttagatatatgttggctttgattcctcttatttgccttctatgtccaaataactttaatgaatacaaagctttatcagataataatactttgatgtacttatttgctcactttgcataatttgtaatatagaaaaaaaatcttcacatgctattttttcttacaaagtaataaaccagctgtatttatgaaccacctattatgagcatgcatttccagcagcagtctctcagtaaaagactcaatcaagttagaaaaaaatgtattagtagaggaataaggttttccttaaaattatttttatacttaaatatgtcaagcctgtagtctgtgtccaaatatttaaagttaagtattacccatttaaaaaacaaatttgactcttgtatacttaaaataaattcaaccacataactattttattttgaagtttttatttgtttgtttttggtttttttgttttgtttttcctttctattaagttaggacaagaaacaaaagcctcccatcaaaagataaggtgaaagcctcccatccacgtttcatgcttgttctccctgtgtattttaaaatctttttctttgtttcttaaaactaaaacaaaataaaaaacacaggaacattattgagatgctatttagtaatattaagaatgtccctgtgtgtaaggttattgatactggcatttgtgaaattaacatagggacatcaatgagagatctataacaggaaagattataggcctgggagggagagatctgggtcaagttttagcttcttccctgagtttgtgtgtgaccctgagcaagtcactaaggtctctgggtcacactttcttcaaagacctgtacagtgagaccatgggagtcaatcattgttatatcttttcactgtggtctcctcttctttttttttttttttttttttttttttttttagacagagtctcgctctgtcgtccaggctggagtgcagtgatgtgatctcggctcactgcaagctccgcctcccaggttcacgccattctcctgcctcagcctccccagtagctgggattacaggcgcccgccaccacacccggcaattttttgtatttttagtagagatggggtttcaccgtgttagctaggatggtctcaacctccagacctcgtgatccacccacttcggcctcccaaagtgctgggattacaggtgtgagccaccacgcccggcctgctgtggtctctaatgagccagtttaatgtttcttgaaccaacctttgctgtttaacacttgcttatcatgtttttaacagggatttctgacctctttgtagaagatttatagttttttgttttgttttgtgttttttgttttgttttgttttgttttttgagacagggtcttgctctgtagcccaggctggagtgcagtggcacaatctcggctcactgcaagctccgcctcccgggttcacgccattctcctgcctcagcctcccgagtagctgggactacaggcatctgccaccacgcctggctaattttttgtatttttagtagagatggggttttgccgtgttagccgggatggtctcgatctcctgacctcgtgatccacccaccttggcctcccgaagtgctgggattacaggcgtgagccaccgtgcccagccagaaaggttcttcagttctttatgtttgaataacaccatgttgtttgtgtgtgtgtgtgtgtgtgtgtgtgtgtgtctgcaagagaaagcaaaagagagattaaaatagatttagaaaacaatcagaattgtgagaatatagaagggattcactaaaagaatttctaatatcactaaaatcctcagctgatgtatcaatgagtctgtgattagctaacaaaagagtgtttttccccccaggtggacaatttggactttatgcaggtgtgcagtagtagaaccgtgaaggtagatacaattaaagttctgagaaatgaaaagacactaggccacgaataatggagcttgccagtagcagcagctagtagatccctttctccacggggccaaagagtttgatttgatttccagctctcaactcctactcaaggtgcaatcatcagtcccctgcagggtactctaggattctggagacattaagaagcacagaacgtggctgcatccctttttccgaatgggctttggtgcaagcagttcgtaagtggctagtaagaatttattgttcatgtatgttttttctcttgggagtctgtaattattttaaaatattagccataaatcccatgctaatatatatataaatatatataaatacgtatttatatatataaatatatataatatatgttttttgtttgttcctttttttgagacagagtcttgctcactctgtcgcccaggctggagtacagtggcgtgatcttggctcagtgcagcctccgcctgccaggttcaagcaattctcctgtctcagccttctgagtagctgagactatagatgtgcaccactgtgcccagctaatttttatatttttagtagaaacaagctttcaccatgttgaccaggctggtctggagctcctgacgtcaagtaatccgcctgcctcggcctcccaaagtgctgggattataggcgtgagccactatgctaatttttttttttttttttttttgagttggagtctcactctgttgcccaggctagagtgcagtggcgtgatcttggctcactgaaacctccatctcctgggttcaagcaattatcttacctcagcctcccaagtagagggaattacaggtgctcgccaccacgcccagttaatttttgcatttttagtaaagacagggtttcaccacattggccaggctcgtctcgaactcctgacctcaggtgatctgcccgcctcggcctcccaaagtgcttggattacaggcatgaaccactgtgcccggtgctaatttttaaaagtattaatttgcttttgcgagactcaattgtatgccaaaaattacctcaatatttgacttggagactgtagaccaaacttgcatcattatggaaaaacaatatgcaaaatttggccttggcattgcccaaagtgtggtattttgcattgtactatttgtttctgtatgtcatggagtatgtatagtaataggaaatgatgagtatctttgcacaaaatgtaatgcttttactaacatctgtcagctattttgtgagaatattgccaaaatataacatttatcttggtgtatagttcaattttgcttttgtgagtgtttcttctattttattgccactaatatagcataacagatgtctttcagatgtgaaaaatcaattatttttcaatatacctcagtagttattagggcagattaatgtaaagtaccgtaagagtaatgtccaaataaaatgtcataagtgaacaatacaattcaatggagaaataggattgagttgatcttggtacctttgtggaaaacagggagaaaaaaatgaacaagtacaacaaaaatatgcaaggccatgctttgttgaaagatcaagtagatgctttagtgatagtattttcagtggaatggtcagctgccatggaaagttagggcaaggccaaaactgtttatgcttcatttctatcgacaaacacgtagctggtttctaatgaagatcaataaaaggtaatcttgggaatgggtatttcagtatccagaagtctttgcaggagaatatgaattatgaaatttatgaaagcctgagtgttaccttttggatgctggtgtttggcaagttcataacaatctttatgttacttatcacaaatgttatttgttttctaaaattttgaatttcaaggcctcaacacacttgagagagagctgccaaataaacttaaacactgttctacagcagaaccagtatgcccctggcacctaggtttagaggggcctggatctggtttcatggcacgagatgcatgcagtcacacagagccccatgcttagaagggaccaatattaaatgcttgatttgatgctctgctcctaccattctgaaattattaatttttgaacaaagggtctcacattttcatttcatagcaggtctcacagattatgcagtgagtcctgagggaagccatgaaaggatagggctctgtgatgattccaacctttctcacctgaatttgggtggcggctctgtagctgctctcctcataacagtgttcctttatttctgtatcccttactctgcctacattttcattctgatatggaggacagaccctctgggatgctaagttctctgaaaggcctgaagtgtcctccatgcttgacttcaggcacacgtaatgcctttgttggacatttatgccatgactcaccttcttgcatagttattcactcctccagctctaacactatgcgaggcatcatgcttagtgccgtgaatagagtggtgaataagatttagtccttgctatcctaagattatactttagaaggatagacaaccaagccaatggtcaaataaaagaagttatgatggtggtagaacagggctcacaggaacatgaaggaggagcacctaaggtggtgatatctaaatagagatctaaggtctaactgcaggtagatgtttcccctttggggggaaatcagagagtgttctagagagggaacagcatgagccaaagctcagaagtgaaaagctgccatcttcaggataattttctccgtagaaaattgcactactagttacattcagagtaggtactagccagagattcattttagagacttacaagtttgccagcagtaagcctatgaattagttaatggttttggctgagaggccaccacagaatatcctgcctgtactttaaccagatttttaatcacaaagttcatgtaatacatgtctgaactggaacatggacatccatggacacattgaaaatttcagtttagtgcttagaagccccaaacattgttgactggaggaaaaaatgttatattagttaacaaaggtatatactgctatggaatgaatattcgtgtgtcctcagcattcatatattgaagccctaaccactaaagtggtggtatttcaagttggagcctttgggaggtaataggtttagctgaggttgtgaggatggggccccatgatgggattagtgcccttagaagaagtgcccttataagaagagtaaaacaagaaaaaaatctctctctccacacacctgcaacaaggagaggccatgtgagttcacagtgagaagctgactgtctataagtcaggaagacagtccttgccaagaaccaaatctgacagcaatttgatcttggatccctcagcctccaggactgtgagaaataaatgtctgttggttgagctacccagtttatggtgtttggttatagcagcctgagccgactgagacaataatcggtactgagaagtaggctgatgctgtaaacaaacacctaaaaatatggaagtgactttggaaggggtgatggacacaggcgggaaaagttttgagatccattctagaaaaagctgagcttgccttgaatgttaaagcctactgtggtgagaaattagaaagaagataggagaggtacagagaaaacttccttctttgcagaatacataaataatcactaacagaatgttgatagaaatatggatggtaaaggcaattctggtgaggtctcagatggaaatgagaaacatgttgttggaaactggaggagggatggtaggattgaaaaaaaaaattcaaaagaaaaagaaaaaaaaagaaatgggaggaaagtaacccttgttataaaattacaaagaacttggctgaattctgtttgtgctcttgtgttttgtgacaggtagaacttgcaagtgatgacatttggatatttatttatttttctttctctctttctttttttaaatagagacagggtctcgccatgttgcccaggttggtcttgaactcctggattcaagcaatcctcctgccttggcctcccaaaatgctgggatctgtagcagactatagatagttcccaactgatgatggttcacctgattttttttctttatgatagatttgttgaggtattaaatgcatttttgacttatgatatttttgacttatgatgaatttgttgaggcacaagcctgttgtaagttgaggagcacttaaaatacatatcagtatctaatagtgtcccaagagtttgaaggattcttttgtagggggacccaaaactttatcttggctacaaattatacaagaaactggactcccgtacaactgaagtccctgtacagttgagcacctcaaataggccaagtaccacagctggccaacacagaataccacataagcagaaagttatctctgtagctaaaattcttcatctaacaaatggctttccaagagttcatttgaaggagaagacagaagtaagtagttggctaggtttttttgtgcctttgtagttggataagcattagaagtattaaagcctaagcctttcaaagagttgatctgcctggaaccttctgcagatcagagctctgtgaaagcaaatgctgactcattagctgggatggtgtgaattccagaattattgctaacaaatctatttccacttaaaatataaaaaagaaagccatgaaatgagaactgactttcccttaggcctctaacagtgctgtttggttacatattttgagaggcagaaaatgagtgaagaaaaagagccaccaagaaagattctctgcaggtgaacaggaaaaaaagtaacttattaccttgcttggtccatagcaggtttttcatttccctttaaaatgtgagaatttgatgactaagatactgctattactgttttcactgtaaatgagttgatggaaagagcatgttgcctgatagtaatctttcatgtgtatgtacaggtacagtaagttgataaaaataactgcattaaaaaggtatttagaaagttctggcagagatagtaaaatggatatatccaattttttgtgctctatttttgtacctgatgtagtcttcatccatggagactgagccctttttgttttcttggaaataaggcattttatctattgaaatgattcaatttcctatcagtctagactgtgatcttacacagtttagtttagttcatctgcagatccttctatttttgatttatttgaatccatgaaagttaacatgccattgtagaatgccagactactttcctctcccttttacatgtgatagactataaaaattatagcttaggttgattattgcttactgggcagtccagcacagataacccaggtgttggttcaaaaaaaaaaaaaagcattctggagtaattgacagcactaaacattttgcttttcagtgaaatttaagagttggtggttggaagctattcatatacacagcatcagcaggaaatccccaactctggatttttaagcatgaggctatttttattttttcattcctatttaagactatttcagaatacgaattatagactcctggttctcactttggagtaatttataatcttagaagattataaatatatagattttctaaaaggtctatccaacattgtattatttaaagtattgattatttaatatgaggtttattagtctttggttttttccctgctaaaattatttcatttatttattcgctttctcccttaagcaacttgtgtttattaactgctgaatctactagaatgtcttcctataagtattaagagtcctagtaaaaataacaacaaaattcataaacatgcacaaaatgctcaaatcataaggtaaagcacaaacaaaataagttaagccacagaaaggcagaagatatttgcaatgcatggacaggtgttaatattcagaatacataaagaacaaactaagaattaattaaaaaattaaacaatagataaaattgataaatacagacaggcaaataaaaaatcctaacagctcacaaataaaggaaaaacgttcgatctcattaatgagcagggaaatgtaaattaaaagcaaaataagttatttcacataaaaaatctaactatatgaaatattgccaagcatgtgaataaagagggactctcatgtccctggagaaagtttaactagtagaaatcttttagagtataatttaataatgtccagtaaatttgaagacacacaaatcctttaagagagcagttccactcccacatatatactctggtatatatagtagtagtgtttcactatcataatcttgcaactttgggacctgacatattagttagtcatgaaatcaatttttaattgagtagaatagaaaagagtgggaagtatcagagtgcatcatatgtagtaagaataataattgttttgtaaaacaatattttccaaaaatgtatgtgtatgtgtgtgcatgtgaacatgtacatttattttaaaatgtattgatttctgagaatcatagtcaaatatactagaaaagcactattgtagataaactcccacgtgtgaaaattgagatattttgtttataatagcaaaaaattagaaacaacccaaatgtggcaggagaaaggatgagaaaggcatgatatccccatataatagacagctgtacacagtgaaaatagatgatctggagtcccatgtattcatagaaatgcatatcaaaagcataattgtgagtttgcaaaaaaaagcaagttgaccaaactatttacattatgatgcctttataaaatgtttaaaacatacagtgatatgtcttatttagacataaatatatgtttaaatttattaaaatatgtacttatacatgggaatcataagcacaaaattcagcattgtgaaggaattgtgaaaagggattgtgaaggaatacacagatctcaatttatgttctgtttcaggaaaaaaacaaacaaaacagaggaattattttctcacatagcaagaagtctagaggcttagccaaattatcaaagacccaagtttcttccttctttccattctaccagtctcagtaggttttcttcatagtcacacggtggctactgaggttccaggtattacatgtagacttgccaagtccagtagtagaaaaagggccattttttttcatgtgtgggttttttgaaaaaagtgagcttttcctagacatccccagtaggttgaccagatgtgcctaatatgcttgttcttatatcagacactgacaagcacaatgggaccaacatggttgatgtatccaagtcacagggaaggaggtgaggacactggaacataattaaagctctaccagtgagaagaagaaaattctgttggaccattagtattggctgtaagtacctctatctgccttagggatacagaggtgaacagcacaagctcctgagtgagttctagtggagttaaaattctaatgaagaagactgataatcaaggacagttgaataagatgattttacatagagataaatccatgaagaagagaaaacaccaggatttatgagacagcaattggagagtgacctggaagccctctctgatcagacgacatttgagctgagaccagaattgcatgaagaaagcagccgtgagcagaactgaataaagggaatccaggaagagcaaatgtgctagtgcaggaatgaggttgttgtgtcggaagtaaaaaggaagtttggtatacctggggcaaagggagagaaatagagaatgggttacaatcaagactgtgaagcaatctgatttacagttttaaaagatggctatcacacaagtgatggtgatggctttttctagggttgggacagtggagataggggagaaatggacctactcatgttgaaatagtgaagagaaagtcaagtgttaaagaaggcaatgtaaagaatcaaagatgagcccagagtagcagatgtgacaaggtttgatttcaataaagtggctcttgggacggaactgaaagactaacctagacagggacgccactgtcctgtgagtagactcttccagaaagaaatagtatgatagtaggataagttctttgcatttccagagttcagcaaggcattcatttatgccttggtgaatatccacagcaagcagagtcctctttgctcaatgttcagaatccaacatatcaggtcctgttttcaggacttccagccgtgaggtagaaagtgctttaacgtatacttggttagcatgaactgctataaacccataaacaaattatggacagaaacattgaagactgcaaaaagatggaatggaaagaagattgccatcaagggcatacaaaatgactgtgtttgaataagtgcgtttgatacttcagcaggtaatttggacagcctttgtgcttgtctgacttcactggaatagtctacatacctgcggatctcgttgttgatacgcccatattgcttccagcgggtgctttacttacctgcaggactgggctttttcttttcctgctattacgctctaatctcctgtagttgcagcctccatcttgaatatgggatttagatcattaactttatatgccatatttaaaaagcaatttcaaccaatagatattagctattaaaataacttcttggttagtaaataggcccatttaaaactgcattttgatttctacatctgaaaatgaaagaccatagtattgttttattttatttttaaaagtccagaaaaaaggtgactatactattcttttccttcttaatccataaatgtgcaccaatataacatttattgatctgcatgcagcgtattggtaaaagatgaattgtccaagtaaactgaagaagacgcacaacatataagtattatataatataggtttcttttagttgcaagtgacaggaaacacaatttaaactaaaaaggaaatttgttcatgtggaactggaaggcctaggtgcagctggatgcagggactcaaatgatgttttttttctctccaactcagcttctcttccttgtcttggctctatttgtaaatggttgtccctttatggtgacaagacagctgaagcaattctagccttatgatctctcaggttcaactcctattttcaatattctggacaaaatctccttgcctatcattgcctctggttgcaccgttcctgaaataacctctgtgaaaaggggaataaagtgctctgattgggtcaaattcctacaacctcttgaagagggtattgaattcattatatccaaatatggggcctaacagtggagaaagggtgctttcctagtagggtattggggtgctgataccaaaataaatgagagtgaaagctgaggagtcagggaacatatgtgccctctaacagtgttagaggcagaaatgttgccatgtttggtttctaataatttgtcgaggaaaaattcttgtcctctaagatgataaatcattcagggagcttctcagtagtttgcttctgaactcccggcactagaggcaggcctggacttagagacagcagaaaggggttgcctaccccatgccacgtgcttgacatagactatctcattgactactcacaaatattttattagtagtcctatcttttaaatgaaaaacagcctcaggcaggctaaggaacatgtctaagttcatgcgacgacaattgaacagcgtggtgcctataggtaataatggggttctgtacatttcagtatcactatgagagtacatttctaatgttctcatcacaaaaaagttgtgtgatgcataacacataacatgaggtgatgaatgtgttacttagcttaatttaatcttttcatattgcattaaaattataacactgctttgcaccccataaatacatacaactataatttgtcaatatataatatgctttttaaagtgccatagtctgtatttgaactcaggtctttctgagggtaaagcccataatctcacctttatagcatgccactgtcttgccaaacacaactcttaactcacttactgggtcaagctttaatttatttatatgtggtatttcaattttgtgccgtaagcctagtggcatcaattttaagatgtaggctttacacatattgtaatgtaggtgttaacattctttaagagtcttaacaagaaaattattagtttctcggtaagctttcattccccaaatatgtagtgaatacctattctgtataagaggacaagagcaatatgaaatgattggctatgccattctgggatggttttatcataatactaagaaaaaaatactctcctggcattccactacagtccaatccaggcttgaaccctcagaagaaattatgaattgtggaacacagcaaactacctcctctgtgcagggctaaccacttctcccttaagatcctctcctagcgtggaacagcgtggtatctgcagccatcaccccagatagtggttcttgagtttgcattgttgatatgtcttctggatagtgctgccctacagagaacccatcttgttttgttcccattcacatttccaggacagagcactgcccagatacatgttaggtgcacaaatatatctcttgaattacattaagtgccctattacagtgatctgccatagatatttggtatagcaacagcattgaacatttaaccactggtaaaattaatatgaaacacattgtattttagaaagtatatatgcattaaatatcacaccacacatacaaacacatattatgtatcccctaatgtatgatttatatgtatataatatttgacatcacagatacacacaatcctttatatacctttatgtatatagattgttctgtaattcataacatttaaggcttttgggattttgtttttaaacaagtattacagcttaaaacatttcctggggtttgaattctcattccagcattttatggaaccataaaatatgaccagtttacctcttctaccttttctaaacttctccctgctttatgacactgaaaacaaacacacatatgaaatgaattatgtttaaatttctgggcaacattttcttagcaagcaacaaaaatatataattctatttttcagaaagtaatttagttctaggaagctgagctgacacataaccaattaatagttgaaaaaaaaaactaccatttgttgtcaagctcttttaattttgctaaaactgggtttgcaaaaggatattgagaaaacattgactgtaaatccttaattcccattttcaaaaccttgtgataatgaataattctttatgatttcttcaacaagtaacatactcatcgtctttatgcttcctatcttttttttttttcaatccagaagtgtgatcatgacaaaagtctatgccaggaatatgtcgatctgacttaatgctttctgagactgttgtttctctccctgatttttgatacttttacagagataatagctacttcctaatctgttttttacttccttgtttccattttatgtttcaatgaaacagcagaatacattacttcatcttaattttcctacttacctgtgtttgttgttgttgttttaatgtgatagaatgtgggatttttactgtttggaatagcaagagagctacagatgaacaaatggaggctaatagataataaaagacttttccaaagacatggactaattggtgcccaggttcagcttgcaggatttcagaaacagcggtgagttaagtcagcaagtcctatggactcttgagagcaagctctttttttttttttttacatttttttattatttttttaaaaatcaatcacttactagaaggcagtagaggctattggttaagagcacagactttggactcaaacaagctatccttggaatttaattctgctgcctcccttcttagctatgtgatactggggtaagtcacttaacttcccagtgtgcttcctgtttccatctgataagttatggtgacattactgagctcttagagtttaggtaaagattgtatgtagtacagcctggctcatactaagcaatgaataaagggtggctaatgctggtttttattactatattttcttcttatactttgacaagcattaatagagtaagtaagcatggctatatggaactcaataacttggaaagcatgatgatggatgacactttttatgcttctattttagccaaaacaactgtttacatatcctgtggattatttaagcacatgccacattgctacaactcatggagtggccttattctatacctaatgatagctggcctggccatgcctcatttcactgccgatttccttctagatactcctagaatccacttattctccatttttactgccactaatctagttcagagtttttatcatttttcactggttctactacaccatcttattgaatatctttttgtttagcaaggatattaaatctattacctttattttgaaccagagaatttttttgaagcacaattcaaatgatgtaatgctcttggtaaatctctttcacagaaccccaaactccctcagagaagagtgatagtctcaccatgatgggtctttttctgtccttctctgtgtctgtaagatagggcagaggaggaaagtgagggtcaggaaagttagataattagcctgaaattacacaactagtgagtgacagaacaaggaccccatgccagatgtgtctgttccacagtccagatctgcacagttattaccacagttattacatagatcaaggatcagccaactaaagcctgtgggccaaaggaatcccactccctgttttgttaataaaggttgattgacattcagccacacccattcactttcatattgcctatggcttcttttatgcttcaacagagttgagtggtcatgacagagaccatctggttcacagtcaaaaatatttactatatggtcctttatagaaaaaacattgctggcacttgacatagaacatacttggattcaaaagagtaaaagtgatagattcctggatgttcaccgtgaggaactctgtgatcagagtcgtctgaaactttaatgaggtggatgaaatgtcgctttaacaaccagaagaattactcaagtagtaagacctaaatatactaagagattttaattacctagatatctattgggaaaacatcttgacaggatgcagattgtccaatcagttatttttaaagggttgctgacagtgcttaatgtggaagaggtaggaagctaaagagatggcagggctcctccacctgactgtgccccagaaagaaaagacgattgcaaacaaaatgggatatgtcatttgtagaggcaggtactgtgaaataaatggcagaattcacagtgctaaggtaggggattagaaaaagcagctgaacaaataaaacgaatcttaagaaagtaaccttgagtacaaaatgttctgagcccaaaacaactgcatatatgcataaatacgtgcacaatcacctgttgaatgcgctcaggaactttgcagttgacctacttggaggggaaaaatcggcatactcaatcattcagaaaagtcaagcatttgtttaaatcaaatatgccaaaattccaaaaagaatttagcatgaataatatttttcacaaaggcgaaaagccttctcgttctctgggagccgttttgtatttgggagattggagagcaaaaaggcaagtgccgtttgtgataataggttctcggagggcagaaataaattatgttcagaatgtacaaggaacatgatgatggttaagcccttagactgtatgtagttgtcctgctagagaactcaaagtatggaaaattacaaaataccattctaagtggtctagtgagtgagtgcagcttccaagtgctatcatttaatttactttcagggagtaatgtgtgtgccctgggtttgtcttgtcaatgctcctgtgcagtggtgcccaaggagaggccagaaagaacttgaggagatctgttggttcctttggatgaagaaatgaaatagaccattttttccttggtttcctcaatcatgtttaattaacttttgtcaagggcctgccgggtgccctgcactggaattggggacatcaagatgagtaaagatctatgtgcgggagaaaaggcaaaatcaaattattgtcatacaatttgatgaattaattctaatactagaggcaatacttgggccagaggctgggtgaagggagagagaagatgaaagacagaagcaggaaggagaggtttagaaatagggcaaagtcacagcatctgtgtgaccagactcctgtcctcaaagtaagtgtttgtgaatactgggctatttatatttccatatattttgtggaaaaccaaaaagtatgatggcagtcttgtggcatgttcttgcccttcacgcagtacatgcaacagaaggaaatatgaggacataacatgtggccagattctccttctgcgagggactatgcgtgtctctgaacatggagaggagaggcctccatcaaccctcctgtgcactttccagcagcttgtagttgggtttgagtgacaaatgcacctccctaggtctgagagccagttacattgctgccaccaatactcaaactccattggctttcttagtagcatataccatttttctaagaaaacaaccaccatttattgattacttactatgtgctggacactgtgctcagcacctgcatccaatacttatttaatcctcacaattattctgtgaagtaagagtcattttacccatttttgagaatatgaagtcacagagccacagagtattgaaataactttctcaaagtcacttggcaatgtatctgactcacacatataatcaatcttaagtctgctgtatttcagatattttttacttccgtagtgttttttgtttgtttgtttttgtttgtttttttttttttgcgacggagtctcactctgttgcccaggttggggtgcagtggcgcaatctcggctcactgcaaactctgccacctgggttcaagtgattctcctgccttagcctcccaagcagctgggattacaggtgcctgccactgcacctggctaattgttgtagttttagtagagatgggtttcaccatgttggccaggctggtcttgatctcttgacctcatgatccacccaccttggcctcccaaagtgctgggattacaggggtgagccactgcgcctggccctctagtgtgttttctattattatttttaaatatagtacttaaaacttatttaaaagttctatggttgaggcaaatccataataactactgcagagtttgaatgctggaatattagaatattagaatattctgggtctagaatatgtttggtcctttccaggcctgaagggaagacagtttccattttcattatgcactttggaagatgccagagaaattaggtgggcatcacatacaagtatcactgttttcactgtagcttttgttttagagaggacaacttgtaaaactttcagtgaacttaggcaaggagcaagccaaccctggcagggcaggccctctctgcaggaaacccctaactgggaggtgcccagctctggcaagtctttgaactgtcagatgccaggtgctgttagggcacctccactcagcccctgcctaatgcaagctcttgaaaactcagagatagcttcctccttcattagcatttgtgctctgtactgaacacaggtcaaagggagatgttaaaatacaccccagagttcacagggccaggatttgaccctattgaaacctgataaataccacccctctattgttctctgggtggaatctggcaccagggtgagaactgggatatgactgaaagattttgttttattgctatcttagtctattcattgttgcagagaccctgacaggatttctcttatctgtgatttgacaaaatatatcttcttaatcattgcacggttgatgttaagagggttcagaagtataaaaggaaggaacttggcttagaaataaagcattgagggactttaaaattaggccactggatagacctattagcctttaaagaggctgagaaattttgatgaaggctgggcctctgaaacgggcaactcttctaattttaataatgcatttgaaattattcttatcacttagtgaattcttatttgattgccttgaggcctttttcaagtttcagattttaattcctcactactccattaggaaggttggtcattttatgttcattttactgttaagaaagaaaaaaatgcagtgagatcgtacaactaagaaatggtaaaacccagactggaactcagtaaatttgatatcaagccctgtgatcttaaaaaaagttactgtggttaaacacgtataacaaaaatttcccattttattcaattttaagtgtgcagtttgtggcatcaagtacattcacacggtagtgcggccaccaccatctgtctctagaacttctgtcttcctaaactaaaattctgtactcattaagcagtaactcttccttaatctctccacctatcccctggatactaccattctgctttctgtctctatgaatttaactgttctaggtatgtcatataagtggaatcattatatctgtccatgttgtagcatgtgtcagaatttccttttttttccaggctggataatatttcactgtgtgtgtgtgtgtgtgtgtgtgtgtgtgtttgtgtgtgtatttatatcacattttgcttatccattcatctatcaatgaacacttcagttgttccttctggctattgccagtgtttctatgaacatgagtgtacagatatctgtttgagctcctgctttcaattcttttgagtatatgcccagaagtggaattgatgaatcatataataactctatttttaactttttgaggaaatgcaatacattttttttcccaaagcagcaacaccttttacatttctgtgctttttttgtccatatctaagttgccttggaatgatgaactagctgagaaaatagcactgctggtgtaacaatgccatatgtagctgatctgatgcttttattgtgtattggtttaacacacatgtatgtcatatggttcatgagcatttacaaatgatatgcttcctctgctgcttaaaagtcatattgaataaaggggcatgtttaactttttcagaacacttgaaatatgatgaaatgtcagtgtttttgaggcgtcaaaacaaatgacataatgtcagtatttagaaactcaactatgtgtaaaacaagttgcttttgttttccaccaggcacaccacagcatgtttaatgatggatattattgttgtgaattgtatctaatctgctccagactcagaaagcctccaacacaaagtgtcatttgttcatcactttgtgggttttgcctgtttcttacatacaaaggttcactaggagttgaacaaaaaacttaaagataggtatggggttgtgtagtcttgaagtgtgtgtgtgtgtgtgtgtgtgtgtgtgtgtgtgtgctggaggggtttttcagctgttctttttatttttatggaacaggatatctccagatgatttcatttgaagggggaaagctccaaattattccaaatgggatgattccatttggagatctttcctcttgcttcaggactgctagtataattcccagagaagcataagaaggccacagctatgcctaaaggagttaaagctggtgcctaatctttgaagtctggcaggcctacctccaccccaaagtcagtggtcaccgctatccaaggattcatcaaattgtgactcacagggtggagaaggctggctttgagagaggtgaatgtgcatcttcctcaggaccacagttgtggggttagctgtcctgcatcagacctctgtctcattttcatgatgaacatcaatgtggtagacacaccgtaacctgacccagaatgagcagggctcttttgtagtcccctcctcttgagtttgggcaaaacccatgacttgctgctagttaatagaatatggcaaaggtcatgggatagtcactcttgattaggttatgttgcataagacttcatcttagccagctggaagagagattcttttgttggtcttgaagctgccatattatgagagggggatgccaaggaatgggccacctaaggaggtgagagtagttcttggttggtagccaacaagaaagtgaggacatcagtcagtcttaacaaccacaaaggactcttattgacagtcatgtgagcctggaagagaactccaagctccaaaaaggaacacagcttggctgacactttgattgaatccaattaagccatgcccagacttctgatccatggaaaccaagacatacaaaatgtatttttctaagtttctatatttgtggtcatttgtcacctagcaatagaaaactaatacaatcaagcacacctttaatgttaccttctctttccctgcttgttcctttcatttttattttgcctttttacctgttttcttgttctgtggattctgtctgatgagaccatcaatcaagatgccctggtttcccccagtgaggagaaaaacacatgacccaaactaggccaatcagatctttctctccaggaatccaaatcttaagaagaatgaaaaagaggctgtatgtgtttggagctgactgatcccagcagtgttgccctgaaacactcttgctaccaattctcctagagagttcctgccacctatctttgccaattcctattccctaacttccttttttattctgtgagctccactagattcttcaaatgaattcctcttctgctgaaattaatcagaatctattctatttgttgcagtcaaaaaattcctattgatacatagagccctgttgtaatcacctcatacatttttttgtctctctgggttgtattatggtcttttttctttctttttaaacttcttttgacggggtctcactttgttgcccaggctggagtgcagtggcactatcttggctcactgctgtctccctcccttgggttcaagtgattctcctgcctcagactcccaagtagctgggacaacaggtgtgcaccaccatgcccagctaattttttttgtagagatggggtcttcctatgttgccaaggctagtcttgaactcctggcctcaagtgatcctcccaactcagcctcccaaaacactgtgattacaggtattagccactatatccagcctattgtcttctttctaaaagatttttctcatcactaagtgttacccaaacatgcagggtttcaaggtaattcttgataggattttagaatcagaatcctgattctaaagataggattttagaatcagaagtctggaaatgatacatgaaaattgtcaagttaccttcttaattttaatttaaagaccacagtttttggttaagtctcataaaaacatctttagacttaggataaatcagaagatgtatactgtatgtagcgatgaaaacataattttttaaactaggaaaataaagagtacagaatggctcccagcagtaaattttctagtttcttaggaggaaaagaaagatcagttggtggtgcaggttttcttgatcttcaaagtgagtgtgtaaagacttctatttcctggctggaaacatcaaagacaaaggaggaatcttaaaagaaataaaaactctagaataaaattaaaaataagaattgaaaagtagagagaagtacaattccactgttagaattaaaattttttgactcacttcttgatatacagaccttctttccttcctggtaaaagcctatttgaaaagtgttacgaagtttctccctcttgtatcttgtcagaatatacaaaaattcagattacagttgacccttgaataacacctgttcacactgtgtgtgtccacttatatgtggactttctcctgcctgttcacctctgagatggtaagaccaatccctcctgttcctcctcctcagcctactcaacatgaagaccatgaggatgaagacctttttgctcactcacttccactttagaaattgtaattaggccagtcacggtggcccacgcctgtaatcccagcactttaggaggccaaggcaggtggatcacttgaggttgggagttcgacaccagcctgatcaacatagagaaaccccatctctactaaaaatacaaaaaaattagctgggcctggtgacgtgtgcctgtaatcccagctacttgggaggctgagacaggagaatcgcttaaacctgggaggcggaggttgcagtgagccaagatcgtgccaatgcactccagactgggcaataagaacggaaattctgtctcaaaaaggtagtaaatgtattttctattccttatgattttcttaataacatcttcttttatctagctgactttattataagaatacagtatataatacataactgtatacagtatgcattaattgaaagtttatgttatccataaagcttctggtcaacagcaggctattagtagctaagtttttgggaagtcaaaacttatacttggattgctgactgtacagggtatcggtgtccttaacccctgtgttgttcaagggtcaattgtatattctttttaaagaagttaaaataagactgttaatacttttattgcactgttcatgacagcatgtcaagtatgataaagcattttttttcttagtttaatttattgaattgtaattaaggtatttttcactgtagtcctaagaatgaccatgctaaaactgtcttgacaagtcctttgctaatgccttaataaacaacattcaacactgttaaagttgggaacaagtttgaggtaaaatttgtgtccatgagagtggacgaatcatggtaaagaaaataatgtggagaaaatatataagaaaaaagtcaacaactgaagagtagatttttgaaagttcagtgggttttgctttgttctagggccaattttagcttccttattaagcattattttgtcaattttcctattagaaaaacataattgagattttgttttgggatttctagaagaaatgagttggtgtttttatggtgtttccttcgaaacccaaaactgaacatggaactgaacatggtcctttacaagatttccctctcttttacatacattctagagtagataaaaatgaaatgaatcttagagctcaggaaatatcgcgatttcaaatggacaatccttgacttttttgtcacattgtttcttcgtggaaaaactcattctctctcccattccaattttccagtagagatttgattgagtcttgagcatgcgttgaccatcttcatatcatgtattatgactgaagtattaaggatctaaaaggtacagagatagattgcacttagcttaggattgttacatgcactctcattcaatgtttggacaacttgatggaataccctggaaagtttgccattatctttccctgtgcattggctccatagacttaatgcacctatcttatggatggaatgacgatactttgtgcttggagacctgaaattgttgctttgtagccctttgctcttatttagccccagaaccagaacttctagaatgaaactctagtaaagaatcagtcaatgttttttgtttgtttgttttttccccactccaaagagaatgtgttttacttttttgtggctctgaaagatatgccaactcaaactcctaggtctctcaggattgatgggtacccttttatgttgcatcaaaattgaagatatactagtgtaaggtctagctacctttctagaattaccatccaaaaaagctgttaatttaaaccctacttcttaagccaagcagtgcatctaaagtgagctttttttaattttaaatttttttttttttttgagccagggtctcgccctgttaccaggctggagtgcagtgttgtgatctcggctcactgcaacctccacctaccaggttgaagcgactctccttcctcagcctcctgagtagctaggactacaggcatgcgccaccacacccagctaatttttgtatttttagtagagacggggtttcaccatgttggtcaggatggtcttgatctcttgacctcatgatccgcccgccttggcctcccaaagtggtgggagtgcaagcatgagccaccatgcccagcctaaagtgagctcttgactgaacctattactgattggactttcttggaagcactgaatcctgactgtatccagcatttcctaaaccaatgagaattctccttaaagcatttgtcctcagtttcaaaggaaatcagttctgagatactctttttctcttataggatactattatggtcttcagacattcactgtatgaagggtttaggttgtagaacaaatcaaatatacttgaaatgcattttgctttctgagggactatggtgtgcttttcttcaagacttgacaaaatttacttttttaaaaattaacttcctcctgtgtttacaccagcttttatactttgttggaaatacagccacttccagagagaatttggcattgcacttatcaaacaggataacttaattattggcacagattattttttatttgagcagtgtgcactgccatgagagagcatccacattttcattctgggcatggaaacaatgtaaaacaggtttggcatgaagcatgtatgtatgtgtgtatgtgcatcaaactctaccctatgtgaaaggctgccaatttttaaaatccttgggaactagagtaattaatctcttctgttgcctataacaatcggaagacctgggaatatttcatccatttgtaccatttggaaaccattattggcccatagagattgatacttcaagaggagtggtctcttgccagcttacttcgtaagttttgcctatctagtttcaatatttcccacccttctctactttatgttgtatcttttccttgggttaaaggtttttgtcagcttcttctgctttgtgcttatatttttcttcctatttacaaaagctcatcttccctcgccaatgaaacaagttatggagtgtgtacatctacacctagctggctctgctgttgtacagaggtgcaaacagggctgtgattttagacatagtagtgtcaatagacatagtagtgaggatgacacagcatcccacgggacaagattgcagtgatgttatcctcacttcaattcaactgcatgactaacaagaacattacagagaaaaaaagaaagaaaaaagattaaagattaatgcttccagtcagtcatgtcccatggggagacatcttagaacccattctacccattgtgaccacacatatatagcagtttttgagaaggaatcaaaactcaagaataaatgacatgttctgatatgttaggcaaatgtcagacaatgacacagagccctaagttaatatttgggaaactaaacttttgaagtacttttatacaaagcatatgctaatatatgcagactaatgcaaattatccataaccttgaggtttctcacaggttgacagtggggtccttggtgtcacagaaggtgaccattgctggtatagattctgacaattacttggattatatcatgacttcatatttaatgtgaattttatctacttagtctgagcagttgctcatttgccaacagttttgcttgtgtatataagtaaacaaacatatttatcacccctaggatcagtaaacgctaataaagttgctgctgcttgcactttagatttgttttaatgacagacacatcctaaattaactaagaatggtttgcttgctttagagcttagcaagaaaggtaaagatattagcatgattcgttgtcaccaatcaggttgaaatgatggtacatgttattctttgtcatcagcatactctatcttagactgtatttttaagggggagtgtgtgtgtgtgtgtgtgcattcatgcatgtgtgcatgtctgtgcatatgcgcacacattttctttcatgggagttctgatgtcactttttgacaaaattcattgtgaactttatctcagactgcagtgaggaaaaccaacagactgaacaaatgaacaaatacacagactcttctcccctactttatgtaatattttatatgcgttttatttaaagccagcactctacatgcagccatcatgaattatcttgtgtgatgtgcaatatttgttaaggtgtgctttgcaaatgctctcttattcaactagttccctgaatgggctgaaacatggtcatttttgttctatacacagacagtatattaaaataaggattaaaaccatgtttaatcaattgttagacttttatcccttcatgttactgttccatctttctttctgccctttgctgatcatctaaaaataaatttgtattctctgaccaatgaactcactccattcatttattaactcttttacagtcttgtttctttctgaagtggtagaaacacttaatagcctactctagtgaactttcttcagaccatgtcttctttaacacctgtcacactcaacaatgttgactaccctctcttaggtggtctttgctgcgtcgtttgctgtcaaccattaacaccatacctgtatccagaagcgctgtcggaaagccaggtctgctgatattgattcttttggtctttttctgtctccactttggcctctcttttccatttctccattgcctgcatgttttcttctttttctgtttgtcaattccatttgatacagctattctatgaagaaaataaaagatattgtttaaaactaaaaccagttatatctacttctatcttttggaaaagatataatgcgtgaagtacaggataggtagtgcttacaatttatttttgttttaagaaaatgcccaggctgggctcagtggctcacgcctgtaatcccagcactttgggaagccaaggcaggtggatcatctgaggtcaggaattcgagaccagcctggccaacacggtgaaaccctgtcgctacaaaaaaatacaaaagtgagctgggcatggtgatggatacctgtaatcccagctatttgggaggctgagagaggagaatcgcttgaacccaggaggcagaggttgcagtgagccgagatcgagccattgcactccagcctaggcaacaagagtgaaactctgcctcaaaaaaaaaaaaaaaaagaaaaaagaaagaaaatgccctaaggagacgggtaggtcagctcagctgaacaagtgtagtcccctggagtctactctatgtctaggctaagttttcttaggtgtttcgcatctattatctttttaaatccttaccacagcctgtttgttatttatcttcattttaaacataaaattactttattttttcattccattgagaaagtcttctaggtgaatttgaaagccaggaggagttgaacatgtttggcattcctcaaaagagaaaagaaatgagggttcagaatggtgaaatttctgaaactaggatgatgacttcaaaagatgatttatgatacttaggttaggatgttgctacatcaggttaaatgctgtcattggtttttgttttccttacaaagaagaaataaatttgtgggtgggggtagggagttactcaaacatacctaatttctaatactctaagctacatatttaaatacactattatttgtatttctcagtttcccattgtttttaatgtgcttttcttaacacattaatgatagcttaaaattaatattttcttcatgctaaaacaaacaaaatgatgagagaaaatttaggtatccttgtaagctagttctcctcttttctttcaatgtaataagcttctttgtgaccctggcattaaaatgttttgaaatggttattggttcacggacattaggctctgtaataccattttccctatcatctggatgtattgctatttgtttgaaggcacattccaccattattggtgccctcactagcagtgagggatgagcctgagtgaacattgggaataaagccagttgtttcctctgctgcattacaaggaaagttattcaggaacatgcccactgtggcaaatttaccaagtggaatatttgttgccttgacattttggactatctactggcatgaaaagtcaacagagaggtatttctacacttgcttaggaattatttgattaaatagcattggaggatagaaataactgttttgttttattttttacttaaggtgtaatcctcttagtcaaccgaagcttacagtggcagtggtattcattattttactcagatttttattctttttcattaatgtagagctttgtacccaaatgcattctatacatgtctctcattacttctctggcagcaagatagcacttcactccacccccaaactaaacagaatttaatgatgggcactccttgcctcatgagggggaaaaacacagtttcctggtcgtggtctctgaactgcaaagacacacttgaggtttatccactgagtaaataactagggtgaaaaagtctttgcctctgcagcatgaactaatatgacccagccaaattatgacccacctgttgatactcttaacaagtgtgagtaggtaatatcatgtttatggtgagtccatgtctctgagtaatttagggctgtgctgctcaatagggtagcccaagccatatggttctgtaagtttacatttaaattgatgaaaaatttagtttttcagtagcgataactacttttttagtgctcagtagccacatatgacccagtttagaccaaagagacttgaaatgttttctggggctcatagttgaagagattttcctttcctgctagacatggacaacaagctgcagctcttggaagctgtaggctgccatcttggggacatggaaagctgccttaggaagaaggaaacactaagggtagcaaagagaccagaaggaagaaattttgtttttggtgatagcatagagctgccacatcaacacttgcccaagacctgttctatttctagacctattatgttcaatactgtggccactagcctcctgtggaaactgagcaagtaaaattcggctagttcaaagtgagatgcattgtaagtgcacaatacacattggattttgaagacttagtatataataataatgtagattgtctcattaatccttttttgtattgattgcatgtttaaaggttaatattttggatatattatgataagtaaagtatgtgaaattcattgcacttattttttaagtatggctactaaaaaaattgaaatcacgtgtgtggctcacattatatttctattggacagtgtgacttcagacatttcagttaccttaacaataaattcctttcattgctcaagtcagtttgaatcaaattttctgctgcttgcaacataaagatttctaatcaatgcttggcataacatttctatttaaactttatttctgcccatttatgcttgcaaccatgacacacatacaaatgtatatgtgtgtgcactggcactcacacatgcgataaaaagtgctttcctgtgttcctaaatatccatctgagatgctagctcattacataaaactttctgactctcagcttttcacatctgaaacgtaaaaaaaagatttgtaacttagatatttccatgactatattcattctactgattattttctgtgtttgattcacttttatttatacactgaattgtcattaaattgtcttcttatttcagttttggggtacttttcttctctctttgattttttttgatgccactaaaattacaaccatttacttagctagtaagactgcatgtaagtggcagtgaagaatgaaaaagaaaactatccagtcaaaagaagtaattttaaaaatgttggagtgtgagattttatactataggaaagtaagtcactaccagatatgttatttaaagattttctttaaacttttaagcctatatatttaatttcctagtttttttttttttctaaaaaaaaggcaaagataaaattacaagctttaagataggaataaaagtcatttggtcatctgtttatgactagaaaacctttatgttctatgaaatgcatatagattaagggaaactatatatagccaaccaaaataaaacagccatgctgtgtgttttatcaaattacttcttaaaataggaaaacactcaataataagctgcatatagctccctaattactacagttttactttatatgatgtttaagggaatttttgagatatctccttaccattttttctatgaaagtgataatttaaatataattttatagcatatgtttttatttttatatttcttccagttctttaggacattaatcattattgaaattttgtccttcccccatctcatttctttgctttttacctccctggctttctttgtattgaaaaagctaggttccttctaggagagaagtgtcctatgtatattctgatttcttttttgtggagaaatgagtgactgttgagtaaagtcatgatggaagtgccatttgaaaaaaacacaagttcattatatttcgttattcatcctaattttcaagtagaattgcagtaagctaatcattgattagggtgctgttagagttggcagttaggaaggtaattctgtgagtgaggtggaaattatttggctaaataatgtggttttccacctttcactattataccgcttttgtgaaatatttttaattttgattatagaaagttttaaaattaaatagttgtgtataaacttattgaatgtaatccctatatatatattaagttctcatcgactgcatggcactatgaaagactatgatttggaaaacctttcattttcctttggggcaagtaccaatgactgtgttaaacaaagtaattcctaaatatggccttaaactctcttccccaaaacaaacacattcctcaaagtaaccctgagtgagcagaaaagcagtagtttactaggtatctctaaaccatatgcccatatcctaaacgtaggggttaagatgaagattttatgtgattagattggacaaatatgggaaatccactcattcatttattcattcattcaaccaacatttatcaaatacttatcatagtgaatctatatcaccaagaagaaagtttgggaacgtttctgctgaggaaagtaggggttatattagcaatgttttattttatgtatttgataccttgaatggatcatttttaccatactttcctctacaagataaaataatttactgtagtaatcagtaataaccggtattttctcttttcttcttgagatgtaatttacatatagtaatactcaccattttaaagtgtataattcagtgtttttttacattaaaaaggttatgaaactgttaccactattgaattccagaacttgcatcattctccaaaataaaccttagacccattcatattcattcctcatttctcttcccccctgtcttctggcagactactttctgtctctctaaatttgcctatcctggacatttcatataaatacagtcctacattatgtggcctctgtgtctgttttctttaacttaatgttttcaagattcatctatgttgtagcatgtatcagtacttcattcctttttatgagtgaattaaaaatattccatagtatggatatagtacattttgtatatccatttatcaattgttggacatttggattgtttcaactttttttttttttttttttttgctcttatgaatagttctgttataaacatttgtgtacaagtttttgtatgaacatatgttttcagttatcctgcatatacacctaggaatagaattgctgggtcacatagtaattttatgtttaattttacaaggaaccactaaacagcttttcacagtaggtgcatcagcagcagcgacgtatgcaagttccaatttgcccgcatggttgccaacacttgtagtttttgcttgtttgattatagccaccctagtaggtgtgatgtgtttgatttattctttagtttagaaagagtgaacaactttttaataaatcataaatttaaaattatataaattattttgatttaataaaatttgcatttttatcaaaattattaaaatcttgcagcttacagtagttcactcaaatattgagcactatttaaaaatgcaagaattcaaatagagtaacataattgaaatagctcaaagtctacttgtctgtaaattcagaggctattattgttcattaagagtcttctgattacaagagaagatatgtagtaccacatagacaaaaactatgcctgaaacaagtttgaataattacaaagaattgtgaacttactctcaaaacaaatgcatgtatctgagtcctcatgtcccttgggccagctgtataattgggacttctgtgaattaacttgtaaaataaaaggataatttaaaaaaaatctaagttgaagcttagtatctgctacagttgtttagaaattaggtcagcaaaatattttggtaagaggaatagtctataactgacattttgaattacagcacatgttgacaataaaaagcagaccaaatttttttagttttattattgtttctaaattttctatatacaacaaattcccttattatgtacacctagggcagaacacttccactgccacactcttggttttaaagcctttttgtttccaaagggaatgctttatgtattacatggaaaacatcttggtaaagcagaaaacttttctgatttggtttccaatcaggaaataactcttcaaccaaagatcctagcccaccctttcatcagagtgcagtagaagtgactggtgcaaaataaataaatgctagaaagaagacagtaaagcttacatagataacctcagggtcaacccaaactattccagagtaataagaaaaacattatctaaaacatattctagagagcaaattgcattagttatctactgctgcataacaaattactctcaaacttagttgctgaaaataataaatatttattatctcatacagtttttggcattcatgagtttaagaacaccttaggtgagagattctggctcagaacctctcttatgagattgccgttaacctgttgatgcagcagtcatgtgaatgtttggttggagctggaggctctatttcaaggcttactgatgtggttgtttataggaggcttcagttcttctccttatggtcctctaagtgaggctgctcaccacttggcaactggcttcttcccaataagtgaagaggtaaagggaggtggatgggagagggcacacaaccaatatggcagctacaatgtctcttacaactttttctcacaggtaacataccatgacttcttgcaatattctattggtcacccagaccaatgctggtgcattgtgggaggaaactacatagaggtgtgaattacagagggtggggataattaggggtcatcttagaggacaactaacccaccaacctccctctacttacattaatttataaatttagatgtttattattagaacacactgcttcttctagaatgttgcttattcttgtcttctctatagttttctgagtaaagtattaaagtctttaggaattgctttacttgggctggatgggctctgcttagtgattagagtcacctactcaccgtatcttttaactgaagttgggtgtccaacaattaaccttccaatttttatttcaagggtagttttaaaaagaggcaggtgttttagctctaagaatacctgtatgtttttagaacagagaaagtgggaacaatggagaatgaagtcacatatattttttaatcttgtttttacagtaggtggttttaagtcctaccatatgatggctggtattttcgagaattgtttctttctatcagtagaaaatgtgtcccttccaacgttccattacttgaatgtctgtgttaacctagaaagacagtaggagactaaaacttgtaatattttcattacttgaaagattaaattatgttttattgtatgagttctttagtattttccctggataggccttttcttcccatcacacaaacaatagagacaactttatgaaatatgagagaattgtattttaatactctgaggtaggatcaagctactttcatcagttgatacaattttcccctaaagaaattctagctgtgagggccaatggacttgggttacatataagaattatatatacattatcatttgcttttgaaagtaattattctaaggctaagttaggtttgaatttgattctgaacaatgatgatgcatttgaactgttagggtaattaggactatatcccattcacccacacactctttttcatgtgtagtcctttaaactgcacagcctttgaaggatggttagtttgtatctggggtttgtgttttgtttttttttttcatctactttttgattgctatgtcattgaaaagtgcttaatcacagagaggattacaaaataaaatcaccattagcataaatcatttatactcattttaatgcttccttcttgtttgtggagttgggtatttggaagagtggagaatatataaccttcttttttagtgtattttgtgaaacagtttttctctcctattttgttttaacatttaaaataagagacaaagtcatcagagtcaaattatgtatttacatttttattagaaaaataattggttagatgaactggcttattaatgtaacataatttattttggaaaattttttaaaagctaaaatctgtatttaatatatggattgaagaaactggaaatatatgaagatatactttgtattatacttttcatccttagaaatgcactgttatattgtttagggagacttcattcagttcctaagtaatttgtttttaattctggaatccttagaaataccatttcagtggtataactaatgggcaaactggaactaacggaaaggaattttatttctttattcctcccaccaaccccaattccttgcacagatttacatggcatggctcatgtaacacaatagaaagattcctgaaaattgtatccaacttttctatccctattttaaatgcactgaagaatagactacttaaattaatctaaaggtaatttttcttgtataactgtggcttgaaaacatttagtttatatatcaactgtgtttaatcattccaagttgtttttattcagaataaatccctaaagcaagctttgctgagtgtcaaccctttgctctctcttacgactgattactatggttgcttctttgcttgtaactttaatttacggaaaacaggctcttggtgtccagaaggcagaatgggcttggtgaaacagatgctagacctaaatggcttttagcatttctgcctctgcctcctggttgcttttgttgtatttctatgggtgccttgaataatgtgagtcactcaggtgggcagagttcatagagattaatttctggcgtgtgaagaggaacagaaagcagtagaggggtagatgttcttaggatgatccacatctgttcttctcttgtccctgtgcttcctggtcacccacctccagtttcagttttattcccattttacgatgaacattaaacagtgtaattaagttatgcaggacccatattgtgttttaaataacacttccaaaagtatatcatgggtcagttcataattgtgaacaagattctcttgtttaacatagcaaagtgaagctgaatctcaaaatattgttccctcttaacccaatggtatgaacaatataaaattaaaaatcagcactgaccattcaccattcatccatccacccatccatccatctagtccaaggaggaaaaaactcccgatcgtcaatgagaagaaaatactactatctagcaaaggaagcagatctaagccccagagactgcatgtctggctttggtaataggcaatgtgcatctagttgctctctgcataaaccaaataggggagaaataaacaaaataaaatcctgaaaacaccctactctcatcccaactgtggagaagctaatgaggcaggctgagagaagaaacagggacatttccctaagggtggcagtcttcttgctcacaagagagtaatattttttccaccttgatgtctccatgatggcatgaaattaggggataaaaaacagaatgaccaaaaacagtcaaagctaattaacttttgcaataaacaaggttgtaattgatcagtaaacaaaagaggagaatgggacaaaggagttggaatgagtagggaagtgtatactagaatccctgggagttgacttcaacctgcctattgccttaatgccttatctctgttatatctgaggaagagagcagctaattgggttaaataaatctcctgaggtactcctgatggaagtagaggctcagaggccctgaggtgagtaagggaaactctctgaagccataggcactgaattgattcccaataaagtgaagcagaccttggcataaaataattacaaaaccagagaggagatggcaaaactccaaaacactaaccaagaccctgccaaagcccaaacactcccccttgacaaatgacccctggtataagcagaactcaaattgtagtttatacgggaagctaaatctcagctaaggtaagaagggaatcaaaaagaattgacccgtattctaatcatgcacatagaggttctagattaacctgcccaagtttatcatggttgacatggagactaataacaggcaaattaagaaaataaaatgtagggaatcaatgaagaactaaatctgtagaaacaaggacacattatgtttcaggggagaaaaatgtgggtataaatgagtaacactaaaacacacctttattaagccattaagtttcaagtattaatggcaaaaaccgcaattacttttgcaccaaattaatataaagatgaaatttttcaggatttggtgagaaaaataaacaagtcacttacaccacaagctcaaaagcagaaacagattatttaatgataaaacaggggattacatggggaaattgtggtaaagggtagaataatcattgatatcatttaagtatagatggaaattaaacgatcatgagattgaggattacaggaagtaaatattgtaaattttgacaacatacaaaattattattaaaaatgttgagagaatcttgataatggaagattgaattgctcaactctctttttagacattgaactagaaggctgtgtagaatagaatgactaaaaacagactttaaaacttacaaatcaccaaggggaaaacatgtatgtaacacataaagaggcaatccatgtagaagcttaaaaacaaaagaaacattacatttagaatgtaaaacataagaagttgattgcatttgttatatcaatgaatatgaatgtttagtacttgttaagataatgatatatatgtaatataaatgagaacaatactcatatattgagttactacatgaaaaaagaaatcccatctatatactatatacaagaaataattctaaagatgttactcattgaattaaaagtgaacaataaggtaaacagttaaatgctaacaaaaataaaactaaaattcataatactactttcagactattaaatccaagccaagaaaagggctaagtgagatgaaaaaactcagtgtatgataaaagttgcaattcacaatgtgactataattgtataaatctttatggtctaaataacatatctaaaatgaagtaaaataaaaagttttcagctgcaggaaatgcaaagagaatttaacaaaatatggtggtggtaagagatgttaattcatcatgtcagccattaaaagattacgtagaaaaaaaattagttgcaatttaaagggtctgaataaaatcgataaaaagttaaagcaaatgtagatgtagaaatagataacttgatagccagttggttggatggattgatgaaagaatgaattatggctatttctagagaatcactttattgcaataccttaggccatacacggaaatgaaacatatattagacctcaaagaaaacttttatatagcccaaaaaggtaaaataatatgaactacctcactggccaatatataataaaactagagcttaatagaaggacaacaaaatccaatcacttaaaaaaaactttcaaataattcttgagttacagaagaaatcaaaagaaaaattataaaagatgaagaaaacaacaaatatttgacaaaatgcaagaccattttgctattacaattgacctagaaaataatattcacggcaattttgaaaaagaaaagtaatgagggatgaactaactttatcagattttaaaatacatcaggaagttgcaataattaaaataaattggtactggagaagagcaaaataaaggggccacccatagatttgcatatttgtaacattaatttgtgataatagtattattttttaaataactgagaaaagagaaccttcagtaaataatgtggaatagctggctaattgttgcagaaaaggataaacctgtatccctatcttaatttctaccttaaaataaattccagatggaagaaagtattaaatatatttttaaaagcctgaaacaattgttcttcaaaagttttgctaaatgtacttagaatcttggcagagggaagtgctataaaaaggatttaagactcaaaatttataaagaaaagatcaataaacttcacaacattaaacatattagaaaacaaactttgaggagaaaacagtatgagaaaggacaaaagactaatgatagactggagaaaattatttgcataaatatcaacattaatttttcttaatttttaaatctcatagacaaaaacaaccaacctcctagaaaaatatgaacagttcatttgtaaacaaagaaaaatcactgggtatttaaacataaattgttggtaagtctcatacagaaatagaagaaaaacacataaatataaatcatagggaaaatctaatatttatacccacattgtttggcaaataattaaacctggaaatttccagagtggatatattgataaaggactctcaattctgaggatataaaatatggtgaactatcttgtgaagtttcagaatatttatcagaaattttggtcatactgtttgaccaaaaatgttttcactgagaggaatttaccctcagcaaatacttggagaagttcaccaacatgtttgtacaatgatgttcattccagctttatttatacaccctctccttctgacacacaattgaaaacaatggtaggattcgttaatatgagactgtttaaataacacaatatgatgaagaattatgaaaatcttttaaaattaactgtttttactgaaagggaaatagctgtagtatatacaattatattaatacttttaaataatcttttttttttttttttttttttgagacagagtctcgctgtcgcagaggctggagtgcagtggtgccatctcagctcactgcaagctctgcctcccgggtcacgccattctcctgcctcagcctcccgcgtagctgggaatacaggtgcccgccacctcacctggctaattttttgcatttttagtagagatggtgtttcaccgtgttagctaggatggtctcgatctcctgacctcgtgatcctcccgcctcgcctcccaaagtgctgagattacaggcgtgagccaccgtgcccggctcttttaaataatcttaaaggtcttccaaccttgcccgagccgggcagggtggctcacacctgtaatctcagcactttgggaggccgaggcgggcggatcacgaggtcaggagataaagctctcctcagcaaatgtaaaagaacagaaattataacaaactgtctctcagaccacagtgcaatcaaactagaactcaggattaagaaactcactcaaagccgctcaactacatggaaactgaacaacctgctcctgaatcactactgggtacataacgaaatgaaggcagaaataaagatgttctttgaaaccaatgagaacacagacacaacataccagaatctctgggacacattcaaagcagtgtgtagagggaaatttatagcactaaatgcccacaagagaaagcaggaaagatccaaaattaacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagttgctggttttttgaaaggatcaacaaaattgatagaccgctagcaagactaataaaaaaagagagaagaatcaaatagacacaataaaaaatgataaaggggatatcaccaccgatcccacagaaatacaaactaccatcagagaatactacaagcacctctacgcaaataaactagaaaatctagaagaaatggataaattcctcgacacatacaccctcccaagactaaagcaggaagaagttgaatctctgaatagaccaataacaggctctgaaattgtggcaataatcaataacttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaagcgaatccagcagcacatgaaaaagcttatccaccatgatcaagtgggcttcatccctgggatgcaaggctggttcaatatacgcaaatcaataaatgtaatccagcatataaacagaaccaaagacaaaagccacgtgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtaccaaaatcacaagcattcttatacaccaaaaacagacaaacagccaaatcatgagtgaactcccattcacaattgcttcaaagagaataacatacctaggaatccaacttacaagggatgtgaaggacctcttcaaggagaactaccaaccactgctcaatgaaataaaagaggatacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcatgctacctgacttcaaactatactacaaggctacagtaaccaaaacagcatggtactggtaccaaaacagacatatagatcagtggaacagaacagagccctcagaaataatgccgcatatctacaactatctgatctttgacaaacctgagaaaaacgagcaatggggaaaggattccctttttaataaatggtgctgggaaaactggctagccatatgtagaaagctgaaactggatcccttctttacaccttttacaaaaattaattcaagatggattaaagacttaaatgttagacctaaaaccataaaaaccctggaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccgtcagaatgaacaggcaacctacagaatgggagaaaattttcgcaacctactcatctttcaaagggctaatatccagaatctacaatgaactcaaacaaatttacaagaaaaaaacaaccccatcaaaaagtgggcaaagaatatgaacagacaattctcaaaagaagacatttatgcagccaaaagacacatgaaaaaatgctcatcatcactggccatcagagaaatacaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactgtaaatcatgctgctataaagacacatgcacacgtatgtttattgcggcactattcacgatagcaaagacttggaaccaacccagatgtccaacaatgatagactgcattaagaaaatgtggcacatatacaccatggaatactatgcagccataaaaaatgatgagttcatgtcttttgtagggacatggatgaaattggaaatcatcattctcagtaaactatcgcaaggacaaaaaaccaaacaccgcatgttctcactcataggtgggaattgaacaatgagaacacatggacacaggaaagggaacatcacactctggggactgttgtggggtggggggaggggggagggatagcattaggagatatacctaatgctacatgatgagttaatgggtgcagcacaccagcatgtcacatgtatacatatgtaactaacctgcactttgtgcacatgtaccctaaaacttaaagtataataataataaaaaaaaataataatcttaaaggtaaggtacagaagtgttaagtttttaaaaatatgcacatttagatagatttattgctacattaatcaatctttttctccccctttccagaaggaaacagaagtaaaattaaatagtgcctgcctttggaaaaagatggggttagttgagtgagagagaattctactcttcattttgctcctttctgtagtgttccagttatctaatccttccacatatcagctgaagttttctaagcagtagttatttttagtttacttccatatatttttaaataccaaactaatcaatattgactgacaatatcaatcagttagtaaaataattgagtaacccctgtttttatatattctgatatgagatgaaaatttaggaactctatcaattttaatacttctgtagagagtttttgcatatgtatattcactattaatacacagaagattcctaagttcaggctgattcctttaaagtgtctgttttacccccacaagaattgaaatagtttcagtatattttgttttataaatatttaacttctgtttgctgaggttgagaaaggcaatattccacaagggtccattttctaaatctaaggcatgaatgattttttcatagttacagtatttatgaaatattgagaatttatgcatgtgaaatgtctcataatggactattttagatttaagctattctttttttaggtctccagtgtaaaattcaaagagtagaagctatagcaaatgaatatgctgcgtttcttgtgctataggctccttaatctttacagaagtcttatttgctcagctagattggtctaaaagaaatggtttaattttctctcaaataattcaaccttcaaaaagaaaccttccatgttgttatttttgcacttgtagtgcatactgggggtgctctgccagcttggcattgaatgtgtttgttttatgtagagtgtggtattaaagtagtggctgaattacttgacataatttgcataaagtcatatctcagtgataaaaattaatgtgttgagggctgtgagtgagttggaatgagtcatttatttcttaatagaaaaaagctttatcttcagtttctatcacacttgaacttcaattacctggaatattttcatttgtttgtttattcgcatttacttaagtgttaatgattattcagtggtttcagcaggagagtgttttaggtctgtctttaacctgagtctaatcatagaaggagttggcacgtatcagaattgtaccgtaaaagcacccctaaagcttgacaatgttctagtgattccattagcagctattaaatggaggtttaatgtctttgccatttggggatctgacagactgaaacttagtattcgttttggcccctgtgaatatcatctgctcatccatgcttataaaaatgaaataaaaagtcagtctttgttcttgctcttgcagaagcaattgtagatttttatgaggaaaacaatgaacatgtcaccctggatttggcagcagggaagagcagggagtatataaattgtctttttgggtgccaactgttttgcaccagcattgtttatattagtgaaatggttgtaagtcgtgtaaattgtatttttttccttagctatgttttatggtgggggggtgtcgtaggggaatgtgcattaaatctgaaatggtctcatgcttaaataccgcagtgtggtagacagttaatcttcagaacaaatagtgaacatgcgtaactgctttattgccgtcaacatatgtcactctgtaattatcctggcttataccttgggatgggctaaggatgcaggagctgtctcagctcagagaattttgttttcattttttgggttccaaacagaatgtattgggagaaaaaaaaatcatgtggatttgcccaatattggtgctcgtaaaaacaattaccctgaaattattagtgctgtatgttcaggacctaggagagcaggtgttgggtaagtctgactaaacagatgtgtcaatacaccttggctcatctgagactgtttgggaaaattcttgaggaggctcacgacaccacacatagtcatttccagttacctggtggtgacatgcacaagtggcatatagagactgggttgcagctgaccttctggtgaccagggaatacctccagagagactgcgatgcagttcgcaactgaaaaaagagccacttgaatactgatccttgatgatgggtatcgccattgaggcagcaagcccaactgtttatcttttttcttatttggtaactaggtgggatggttgtatagaaaaatgtgggtgggaatgaccacagaccgcaaactcacgtttgcaagaaatgtagctgtaattttctgtagattttacccatgtcgtcctctatacatagagagatcatacatccaggtttgcccagaagagtccagggttatgacttgtcctgaccctcctttttccctcccaagagtttcccagtcatgccagcataagaacttttccctgagttcgttatgatggaagaaccttgctgcttcaacggagagagccatggggatttaaaatacacagagaaaggcctatcagtacattataatatcatttccttcaaagtattcaaaatttccttagtctgtctctagttctccaaagggtgtatgtaatattataatatgtataaccgagatgaaaattgttggccagtggagcagcaagcatatttcttggataatgtagtgctttatttgggaggacttgatatcctttggggaggctcattgattttatgagatcattagtttacttattattcaataaatttaactcctctacactcaaacctgtagtaaaatatgttttgtgactgtgatgttctcttttcagaagtgaggctgggctggcaatagctggctggaacatggtctgggaaggaaatgggtgaggtcaaaagtggtgagacaagttgctgaagaacaggaatctgctatgcgaaagaatcagagtgctcccttagggaccttaatttaggggtcttgaaatatatcacactctcccaaaactaattcatgcttcaactgccctcattaatcataagtcagttgtgaaagaccataatgacagtaactgcctacgtggatcacattttgtaaaccaggttttagtcgcagtatgcaccatactgaccaaatttgtgtccatgtaaatcactgttcacatccatccagattccatttacatgcattcaggcactagcatacatacatatagatatacatgtgtttgcataaggagtgcatatagttatatatctgcatatagaatttacatgcatacaggcactagcatacatacatatagatatacatgtgtttgcataaggagtgcatgtggttatatatctgcatatagaatttacatgcatacaggcactagcatacatccatatagatatacatgtgtttgcataaggagtgcatatagttatatatctgcatgtagaatttacatgcattcaggcactagcatacatacatatagatatacacgtgtttgcataaggagtgcatatagttatatatctgcatatagaatttacatgcattcaggtactcgcatacatacatatagatatacacgtgtttgcataaggagtgcatatagctacgtatctgcatgtagagaagtatctttgaaatcaagtgatctggctccataactgtccttccatgcacacagcttgcctcctctcctgcccttaaattggggctgggaagggactacctgcctctctctgattccaagtgacctcagaaagtacacctgctcttcacattcacatgtttaattcgtacctttctaatgcctggaggtgatttggatatctggatgattttttccctttttctttcctacttcttcagaataaaccacttcttaatattctttgccacttttgtttcaatgctgccagaaggattttcttaaatcacaggcctaatacttttatttcagtttcccagaaacttttgctagatccttactgtgtgaaaaatgaatgcctcatagcatggcattcaagggccactctgatctgacctgcagtttcttgcctcccttttgcatcatctctgccaggaaacccagatcgagcttgtgcttcccaagtcttgatgcttctccatggtcttcttgtgttctccgcttctttaaggttcacctgaaatgcagcgttctaccaagcattggccagttctcataatcagtttttcttttctgtgagcatagtggatttttatcatttgagcataaccctatcaatgtcttgaattatgactgtgtgcatacctgtagtacctgttaattataaactcctagaaggcagaagacatgtctttttattctttgtgtctctcctagcatctaacgcaatacctggtaactactaagactcaataaatacatgcaaagtgaagacaaaaattaattccaagctaaaaaatgttgctaaaactttgaaaagactccttgttgaggatcaaaggtttttgataatggcaaatgcctagataaccagtatttctcaaagtaaagccccaaaattaccaaccaatcgttctgtccacaggttacctatcatttaaaagaaaaatatttgttcatatatatacattcaaaatttttggaagtttgaaatgtaagtttagttatggttttcataggcatttttttgttattttccatttttactacttttatttttttattattatactttaagttctagggtacatgtgcacaacgtgcagatttgttacatatgtatacatgtgccatgttggtgtgctgcacccattaactcgtcatttacattaggtgtatctcctaatgctatccctcctccctccccccaccccatgacaggccccggtgtgtgatgttccccaccctgtgcccgagtgttctcattgttcagttcccacctatgagtgagaacacgtggtgtttggtattctgtccttgtgatagtttgctgagaatgatggtttccagcttcatccatgtccctacaaacgacatgaactcatcattttttatggctgcatagtattccatggtatatatgtgccacattttcttaatccagtctatcattgatggccatttgggttggttccaagtctttgctattgtgaatactgctgcaataaacatatgtgtgcatgtgtctttatagcagcatgatttataatcctttgggtatatacccagtaatgggatggctgggtcaaatggtatttctagttctagatccctgtgaggaatctacactgtcttccacaatggttgaactggtttacagtcccaccaacagtgtaaaagtgttcccacttctccacatcctctccagcacctgttgtttcctgactttttaatgattgccattctaactggtgtgagatggtatctcattttggttttgatttatatttctctgatggccagtgatgatgagcatttttttcatgtgtgttggctgcataaatgtcttcttttgagaagtgtctgttcatatcctttgcccaagttttgatggggttgtttgatttttttcttgtaaatttgcttaagttctttgtagattctggatattagccctttgtcagatgagtagattgtaaaaatttgttcccattctgtaggttgcctgttcactctgatggtagtttcttttgctgtgcagaagctctttagtttaattagatcccatttgtctattttggcttttgttgccattgcttttggtgttttagacatgaagtccttgcccatgccttcataggcatttttttttaatcttgttaagtactattatgctctccaaggctatgaaaacattgcaaagtgttggccatgctgtctcagcaaatattcagttaatggtgcacttcccccaaaatatatgatttcctgtagttttttctaattatttatatctgttaatttttttcttttttattgttagtattttgatgaatcatattctcgattcacaataagcagatcaccagcacaaaaacattcactagagaaggggtgttcaatcttttggcttccctgggccacgtagaaagaactctcttgagccacacataaaataccctaacactaacgatcgctgatgagctaaaaaaaaaaaaatcgcaaaaaaaaaaaaacctcataatattttaagaaagtttacaaatttgtgttgtgctgcattaaaagccatcctgggcctcatgtgggtcgtgggccgcgggttggacggtgccaaagcatgaatgttgtgattacagtagtaatataaatactacaattcatgtatatatttttaattttaatatagagacatcatgttgtccaggctggtctcaaacttctgggctcaagcaatcctcctccctcgacctcccaaactgttagaattaaatgaaccactgcacctggcctacaattcaaattaatgtaaaaactgcaagtggttggtgatcaaaactccaatgcacatgtagactataatttgttcatgtcaggatagtgtgatgggtttactcaagcagccacaaaagaaaagtttgaatcagaaataagatgtgaatgatttttatattttattttatattttttaccccttatccaattataatacatttgtcacatagtgactttgaaactttgaaacgttcttccagttttcaaacaaaacacaatgacctttttgttgaactgattaagtttctctggaaagtaagataatactttccccatcaacattaatgtattttgttgcaaaaggtggggaaatcaccaaagtcataagagcataattcaactttgcactctttgttaaaaataatcaggtaaatgtcacactatgactgagatggtggtaaaataagccaaaagtttaatgacaaatgttatgtccagcggggaaacatgatgaacttttggcaacatttctgaaccaaatggacacccctggaatctgccagcactggaaaagcggttgctgtcctggaagagtggttctatattctgttctatagtacttactatgcttactatagtactatatactatacttactatatactatataccatacttactatagtacttactatagagcacagtacagaagaacgggctgtataaatcagcatttggcacttgtgtggtacatatatgagggagtggtgcctggcaactgtttgccttacttgttattggaaatccaaactctagcaatgaaagttatttttaactcagtaaatggttatcttggagtctgtgatgtagcctagaaaacataccccggggtgaaggctgatggagcacagccatatgtgcaacaaggaaattctcacactgctgtattcacagatgacatttggtggtcaacgctatgcttcctcatactgatttggtggtgaaagaaatactcaaaaaattatagccatagatgtaagtctttgggatttattttctgggtttcaaggataaatttctgcttttccaaattgaagttcatcagggagtagagaaaaaatgaattactctatttttttttgaaaaaggcatgtttttcatacgacaccaataatacaaataaaggccacttttatttgtatcagttattcaagtgacaccctcagcaatgtatttgatgtctgaataatctgaacccttcttttctgggcagaaacattttattccaaagacatctaaatatttgaaagaaataccaaacatttgccactgttcttaatgacaattaattttaaatagggcttctctagtacagtacaaataaagactaagaaaagaaacaagttgggatgtgaaactggaagcctctgggagtaaccattaccacgacatttaaattgtgactgaaaatgtgcaaataacaggttctctttaactgataagaaatgatttttaatttaaaaaaattttatataaatttgtttttaatgtttaaaaattttacctaaaagatgatgtttgcatttctgcctaatgttcattaagtgggttttaagtagtgaaaaattgaagaaacaccaccattgatatgaaagtggtgactagttttgaaaaatttcaaaaaaattgtttataataaatgctttcaggcataaacatattaatagtataaatatgtacaaatatgtactcactagcaacaatgtaattaagtacagataatataatttatgatttaaaacatttaaaatttatttgttacatttattcccaatctttgagctttcaatctcatacagctttgatacattctgcaacttgcaaaaataattttcggttgtttcataaattgataatgtcttctatataagtattttctgctctttgtttaatctttctcttgaggcatctattttgatttttcctattttctcatgaagaatgaaatgctttagtgatacggaatataggatttctagaaatcttggtaattactgaaatctttgcatcatacggagtatctgtgttgagtgttctgatccttatttatttacttttggtaactatcattgtagtagtgaaaatggaaatcagggccttgttttcttgtcttaattcttggcttctcagttttacagacagtaaagagatcaaataaagtaacatactatttgtccaatgtaaagctaattttatcatattttgcttctagaaattcagaattcacccaaagtagcacaattagagcagggcgtagtagagcaagatctcctcaactttcctcatatttcgttgactgagacatgttgtgatcaaagaatagatttcatcaaagaagtctttttgttttttacattttccatctcttttcctgactcctttatatgacgaacttcatctgtacacctgacttttcattcctatattttagaaaagtaatagcttctgggagagaagagaggaaaggaaaatgatcttttgttttggaaccatgaaagaccaagatgaggcattctgagatgccaatttcatgaatttgtctttgagaagacaagcaaaaagtgatagtaagctgttctttagcatagaaatttgtttctggttttgtcatcatgattaatcattctgatttgcagccttacttgtttcaatcattgaggccccattttaatgtgattaacatttttgttccatttatggagcagtactggcccctaatttttgagaacaggataacccttgattggccttatgtaaataaatcgtaacttaatgcccttgaaattggagtatcccccaggagaacaagctgtaaatcagagtagaaaaaagtgagccttaccctgggggcgggagctccacatggcatattcaagatgaaccaaatgcctttatttcagaattttaattcatggtactttttccttttcaaatggtgctgtcatcttgaaatgacagagattgagtgctaaattgctattgcataattttccttatctctcatctatagactggatttgattgaaagttcagattttgtgaagaatgttttacataggaaattttgaaatatggggaaacattatttttacataaaggaaaggagaactctgtgtgtgtaaaacggagttagcattttttttttttttttacccagccagggtctttgtgtaattataagcaaatagctattatcattccaacagattttttttcctctttgattctttctagcaatctctctctctatgtagcttcttatccctttttgtgccttaaaattattatgctattttttaatagtaaagaggctgaaacaatgtcctggaatccatatccagtggtgacaggagactaatcattgcctctgtctgagttatttgaaaatgggtccacactttcatgtgcgtccgtgtgaacagaccaccaaacaggctttgtgtgagcaacaagactgtttatttcacctgggtgcaggcgggctgagtctgaaaagagagtcagtgaagggagctaggggtggggccattttataggatttgggtaggtaaaggaaaaaggggggttgttctctggcaggcaggagtaggggtcacaaggtgctcagtaggggagcttttgagccaggatgagccaggataaggaatttcacaagataatgtcatcagttaaggcaggaaccggccatctctatgtgtatgtgcaggtcacaggggatatgatggcttagcttgggctcagaggcctgacattcctgtcttcttatattaataagaaaaataaaatgaaatagtggtaaagtgttgggatggtgaaaatttttggggggtggtatggagagagaatgggcgatgtttctcagggctgcttcgagcgggattaggggcggtgtgggagcctagagtgggagagattaagctgaaggaagattttgtggtaagggatgacattgtggggggttgttagaagaaacatttgtcatgtagaattattggtgatggcctggataccgttttgtatgaattgaaaaactaaacggaataagagaaggagaaaaacaggtattaaaggactaagaattgggaggacctaggacatctaattagagagtgcttaaggaggttcagcatagccttgccagcaaagattatttatttactttaagagttaggagtggcggtttggggatagcatcaggaggtatcagctgtgatggcttggaaaaacagtgtaaactggcactgtaaacaagagcagggcatgtatgagtagttgagaatggtgaataggagtatgactagacagaaaacagcacagatgacaagttttttggggcgcagtccaagttggtctggtgtctgggatgagactggggcctgataaaaaggagtgtctatacaggagctcaaatgggccgtaccctgtagcattctgaggacaggcctgacttctgagaagggaaagtggtaaaagtattgtccagtcctttttaagttggtggctgagcttggtgaggtgtgtttttaaaagacttttagtctgttctactttccctgaagactgaggaccgtaagggatgtaaaggtttcactgaatactaagagcctgaaaaactgcgtggctgttttgactaataaaggctggtctgttatcagactgtatagaggtgggaaggctaaactgaggaattacgtctgacagaagggaagaagtgattgcagtggccttctcagaccctgtaggaaaggcctctacctatctagtgaaagtgtctacctagactaagaggtattttagttatttgacttggggcatgttgagtaaagctaatttgccagtcctgggtggaggcaaatccttgagcttggtgtgtagggaagggagggggcctgaataatccctgaggagtagtagaatagcagatggaacactgagaagttatttccttgaggatagatttccacgatgcaaaggaaatgagaggttctaagaggtgggctagtggcttgtactatagcatagcctgcctttgctggtgtgtggcgattaggcctggtggagctgccatcagtaaaccaagtgtgatcagggtgaggaacaggaaagaaggaaatgtggggaaatggagtaaatgtcaggtggatcagagagatgcagtcataggggtcaggtgtggtatctggaataatgtgggaggtcggattgaagtccgggccaggaacaatggtaattatgggagactcaacaaagagtgagtacagctgaaggagccagggagcagaaagtatatgcgtcaggtgtgaggaagaaaatagattttggaagttatgagagctgtagagagtgagttgagcgtagtttgtgattttaagggcctctaaaagtattagggcggcagcagctgctgcacggagacatgatggccagcctaaaacagtaaggtcaagttgtttggacaaagaagctacaggacgcaatcccggtccttgtgtaagaattctgactgcacagccctgcacttcggctgtgtgtaatgaaaagggttgggatgagtcaggaagagctagggtggggacagtctctaaagctgtcttcaaggaatggaaagatgagtggggaaaggatttaggatctatggggtcagctaggtttccttttgtgagtttatgtaatggttttgttaggatggcaaaaccaggtatccaaaggcaaaagtatccaaccatgcccaggaaggaaaggagttgttgttttgtagaaggtgctgtagtttgagagatcagttggacactatcggcagggagagcacatgtgtttttatgagaattatgccaagataggtaacagatgaggaagaaatttgggcttgactgaagtgatggaggctatctgtgagggcttgcagcagtacagcccaggtaatttgctgagcctgatgggtgtcagggtcagtacaagtgaaagcgaagagaggctgggacgaggggtgtaggggaatagtgaaaaaagcatttttaagatcaagaacagaatagtgagttgtggaggaaggtattgaggacaaaagagtgtacaggttgggcaccacagggtggataggcaaagcaatttggttgataaggcacagatcctgaactaatctgtaagacttgtccggtttttggacaggtaaaatgggggaattgtaaggagaatttataggttttagaagcccatgctgtagcaggcgagtgataacaggctttaatccttttaaagcatgctgtgggatggggtattggcattgagcgaggtaagggtgattaggttttaatgggatggtaagggatgcatgatcagttgccaaggagggagtagaggtatcctatacttgtgggttaaggtggggggatacaagaggaggatgcaaaggaggctttggattgggaagaagggcggcaatgagatgtggctgtagtccaggaatagtcagggaagcagaatgtttagttaaagtgtctcggcctaataagggaactgagcaggtggggataactaaaaaggagtgcttaaaagagtgttgtctaagttggcaccagagttggggagttttaagaggtttagaagcctggctgtcaatacccacaacagttatggaggcaagggaaacaggcccttgaaaagaaggtaatgtggcgtgggtagcctccatattgattaagaaggggacggacttaccctccactgtgagagttacctaaagctcggcgtccacgatggtctacagggcttccgaggcgatcaggcagtgtcagtcttcagctgctaagccgagaagatctgggaaggagtcagtcagagagccttgggccagagttccagggggctctgggagtggctgccaggtgagttggacagtccaattttcagtggggtcccacagagatgggacgcggcttacgaggaatcccaggctgcaggcattccttggcccgatggccagatttccagcacttgtagcaagctcctgggggaggaggttctggaggaatgcctggctgctgcggttcaggcgtttggaagttcttgtgtgctggagatgtggctggggtttgtctcacagtggaggcaaggaattgcaactcagaaatatattgctacttggctgtctctactctattattgtacaccttgaaggtgaggttaattaagtctggttgtggggtttgagggccggaatttaatttttggagttttatttaatgtcgggagcagattgggtaataaaatgtatattaagaataagacggccttttcaccttttagggtctagggctgtaaagcatctcagagttgctgccaaatgagccatgaactgggctggatttttatatttgatgaaaaagagcctaaacactctctgatttgggataaaggaaaaggagcattaaccttgactatgtctttagctctagccacctttttaagagtaaattgctgggcaggttggggagggctagtcatggaacgaaactgtaagctggaccgggtgtgaggagggaaggtgataaaagtattatagggtggaggagtggaggctaaggaagaattgggacctagctctgcctggcgaggaggggaggggtcagatgggtctgtagaagaggaagattagaaagactcagcgacgcttggggttgggactgaggggacaggtgggagggaaagaaggaagatttgggatgagttgcattgggaacagagactagggagggaccgatgtgtaaaagaatgcctggacgtcaggcatctcagaccatttgtccattttacgacaagaattatttagatcttgtaggatggaaaaattgaaagtgccgttttccggctatttggaaccactgtcaagtttgtattggggtcaagcggcattgcaggagaaaataagatgcttagattttagatcaggtgagagttgaagaggttttaagttcttaagaacgcaggctaagggagaaggaggaatggaaggtgaaagcttgcccatagtgaaggaggcaagcccagagaaaagagagtagagacacggagaagaggtgggggttcttgccctccagaaaagcagagaaggggtttggggcatggaaataaggggttggggcacagagataagaggttgggggcgtggaaataagggattggggcacagagataagaggttagggcatggaaataagggatcggggcacagagataagaggtcagggttcctgcccctcccctagaaaagtgggacttgccactaagggtgaaggtgaaggggttgaggggttcttgcctctcccccagaaaagcggagaaggggtagagacacagagaaggggttggggttcttgcccctcccccagaaaagtgggacttgccgctaagggtgaaggaccaaagcaggcgtccctgcgtggactgacacctctgaaacctgggtgaataatcagagaggcatccctgcaatgattaaacaccaagggaaggctgccttccctagtccatgactggcactggagttttgggtccacggataaaacgtgtctcctttgtctctaccagaaaatgaaaggaattgaaattaagagaagggagagattgaagtgtggtgccaagattgaaaggagaaagaggttgagggatagtgagagaggttggagaagagagtaaaaagaggccgcttaccggatttgaaattggtaagatgtttcttgggctggtcagtctgaggacctgaggtcgtaggtggatctttctcatggagcaaagagcaggaggacaggggattgatctcccaagggaggtcccccagttcgagtcacggcaccaaatttcatgtgtgtccatgtgaagagaccaccaaacaggctttgtgtgagcaacgaggctatttatttcacctgggtgcaggcgggctgagtctgaaaagagagtcagtgaagggagctaggggtggggctattttataggatttgggtaggtaaatgaaaaaggggggttgttctctggcaggcaggagtaggggtcacaaggtgctcagtaggggagcttttgagccaggatgagccaggataaggaatttcacaagataatgtcatcagctaaggcaggaactggccatctggatgtgtatgtgcaggtcacaggggatatgatggcttagcttgggctcagaggcctgacacacactatagcagttcccatgaaaattagtgtaacttcctagataaataaggtatgaactcacaaggaattgtcatagaacaataagatgattccacatgacaacatggacctgtctcataagcataatgttgaatgaatgaagccagatatggaatacatactgaatgattccaattatgtgaagccttaaaacaaagaaaaataatctatgtagtcagaaatcagaattttagggtagtgtctctattgggtgagtagggcctggaaagcatatggagggcttctggggcattggtcacatcttgtttctttatctgtgtgctggttgcaagaatgtgttcagtttgtggaaacccatggagctgtatacttaagtgtatttttccagaaggattttttatactttgacagaatgttcaaaggatgtcctcttactgtgaacaacacaaatgattggagttataatgacacccttgctgtttgagggtgcatttttcaaaggattttagtcacagattcccatgttcactgaagctcaatagactatcccctacctgatgacaagtaatttgcttctttctttagtcctgcttttacctctggccatgaagaatcctgctttccactggtgagttcagaaatttctagcagcgatatttcttcagcccaaagtaaatatcctaggacatggaagaagcagtatagcccctgccacactctgactcatcttatccctgcaactcagttttctcattcctcaccgtcacttgcaggtatgaactggcaggaacctttccacagattttccagtgtctaatacaccatctaagaggtaaatagcctgactggagagaagctgacagtgggcagaaaggtctggcttatccaactggatgaaagctctctacctactttgggcagatgagtcacatgacattagcactttaaagacagagttagctatgccacttgtcttggttagctcgggctactataacaaagtaccataaactgggtgacttataaacaacaggcatttattcctcacagttctggagtctgttagtttgagatcaaggtgccagcaagctcaagttctagtgaccccctcttccactttacagatcccgtcttgttgcatcctcacaaggtgagaagagagtgagagagttctctagggctctctgttactggagcactaagcccattcataagggctccaccctcagggctcgatcacttcccaaaggctccacctcctaatatcacattggggcttaggattgcagcacatgaattttgggggaacacaaacattcagtccattgcatcactctcaaaagtaaagaggcttcttatataggaaagcattttcagtctttagaaatcataaagtaaatggttcacttgagtgaggcaagatgatcagtggggaaaagagtgagatctgtagccagactccctaggttcttattatggctgaaatctaggctgaatgggttaaaagtttatgtccttgtgtttcttcaatttaaaaaaaatgaaataagaaaaataatagcaacagataataaggatatagaagaactcaccttgtttaggttactgggggttatattaagaactcaaaatggtaactgttgctagtatatagtgtagagtcctctattcatggtagataatcaatagatgttgcctaatgagtataatttgtcagatgattctgatcttgtgggcacccctctttccctacagaaaactcttcaaactcacatagactttaggctgcaatcctgtctgccatgcagtttgctctcatctggcccttgcctcccttccagcctcatttctcactgctctctcttgccctttatactctagtgggacccacaggcttggagcatccctaacaatctgtctgattctccatgactttccttagcctgccccctccacctgaactgcccaccctgctactctttacttgagaaacttctctcttcctttcctttcttcagattcatcttcttcaggaacttactgactcttcctagtgatgtcaggctgagtgaggtgagccccttttgagattccattgtgctggagcataatctctgagcctatcatgtatctctctttcttcattagaacaggagctccctgagtgtaggaacagtggttttatcaccatgggatccctaatacttaaaagagttcttgttattaatctatcgaatgaataactgaaccaacaaataaatgacaaaaaagagacataggtggtgatcttccttagaactataatctctgtatttatatctagcattttcatttagaacatgaggaatagaaaaaaaaaaacataaaatgacccaatggcttttagtgtgtctcagttttaattttgcaaatctggtgctttgcttctatgagttaccagcaatgctagtcaactctgagtcagacatcctggtgtgtgggttttaaataatgcatttcctttacccttaggtggtaaggtgtgacatttgctgctttgataaaatctccagatgatggtacttacacaggtgcaataaggtccaagttgttaaccttatctcacttgcaaatctgcaatttcctttttcctcaccttctttttgagatgtgactaaagaagtgatggcaaggatgtgaaggattaggcaagagacatcctgggttgggagactgcattctatagtaaaaatcctttgtcctttatttcccaggttgaccatcagggtaatactactagctcattgctcagcttttcactttgctttgattggaagtcatcagtgacttagaaaaaaaagctttaaaaatgcaaaattattacttttcatcttagtaatagaagcagtagctttcttaatggtaatccactttttttccccctttggttttctttttagcaaagattggtcactgttgacttatctctcatttacttataataggtatcatgtatccccttgactcaccccaatttaagacactctctgataaaacctgtagtgctttgcaccttcaagttaattacccaagtatccctttctaccagatctcctaccctaagctcatcctatacagtatttctggaacaaccaccctaggcctgggtgattcatttcagctttcttcctccctttccaggagaggggaatagagtgcctgggggagagaatgggaagtcaagggtcttcagaggaaataagtggtttcctgatctgcttcttttccttctcattccttcctcttagcagaccctcagaaaacctggatttgactcaatagaaatacctgtattagccaagccatttatacaaatgatttttccccatgcttttctctggaccctggcagcaaaattaaactttaaaagtaaaaagttttaaatttcatcattaaatctgtatcacattaactttttcctgttgtgagcttttatgtgatttcagcgctaagctggtcaaatatgttacaatttcctagtccattactgttatctttcaccactatttagtcacattttgaaaaagttgacttagtcagatctggcttctctaataaaatgccacagactgggtggcttaaacaatggacatttatttttcagggttctggaggctgggaagtccaagactaagatgccaacagtctcagcggcttgtgaggaacggctctctggaattggagacagcctccttctctttgtgcactcacaatgccttttctctgatgcatgctctcagagagaagggcactaatcctatcatgagggtcatgctttcatgacctcatctaaatctaattaaccacccccccccacctcccccccccccggccacccaggcttcacctctaaataccatcacatcaggggctggagctttgacatatgaatttagggaagacacaggcattcagccataaaaatggttatgtgaacctgttgtgtttctgctgttaacattgcatggtcctttcatttagtaagtgtgttttgattagttgcttcttttgcaggtgtgtgttttgattatttgttctctttctataagctcaacagctagtgttgactaatagcatttaagttagtgtcctgaatagtttccaactgacccctaatccacacttcatcccttgacacactgacctctatgaattgtatcacctgggctaccccagccaatggtgggcactggcaggaaatctgagtacaggacaagagagaggtcaaggtgtttattattgtacctgcagatgctggttagtggtggctgtatccctcttcagaagtagccctctttcccagccatatttctcactgggctctaatcaccactttctcccattgccctgtcaggcccacaggtggccaaggctccccattgctgtgaacctcagggtgctttatcattttacaactttgaaaatagccccttcattaaattctcttcagttaccccttggagtgtggcaactctccctgtgcccccaccacccctcccattagcaacacataatgtgtagttcccattatgaaataaatggaggtgttttatcactttattttgaatcacgccaagctcccttggcagtgacacataataggggatattctccacctttgtggaaatggcttcaaatggatatgtttttgaaacgtggctttcaacttgcaggtttcttttctaaaactcttcaaataggcatctcttcctctttgttaaaagtaattcaaatgataagacagtaattatgattgtaataataccaatagcagtagtaataataatagcaatcagcattcgcagtttagaaaatgtttttgcatatgtgtttcccatcttatccccacaaaatcctccagtgatagttaacatttttttcctgattttacaggtgagaaaattgaataccacagagaaactctgttcttttcacacacctcaaaatttagtaaaaggcaggctaaattcaaatagggtctttcaagtacaaatcttttaactctaccacagcagaagtgtgtagtgaaaatagagagattaggaggtcaatgacattatcttcaatttgtgtttgtgctgagttcatttcaatagatgtccttggccctttgtcacctgtttgcaaagcaaatgaaaatctcatactcagttccggcaatattagtcattttcttgaaggatagctactggtttgtctgttttcctgagtccataattcagaaatcctatgaaaagatcattaacttgttgagtagactgcaaaatagacactaatggaatataaagtaattcaagagctttgacgtctcagttacaggatgacaaggagttatgtattgaatacacatttatcaccaggaaatctgaagatgttgaccatggttctgttcttttcctttaatctccatttcttgccaatccaatgtatttttctccctcaaatgcataggccagtatctgcaatacattgtgtttctacccacaaagttaaagaggaaatttcttcttcctttttaatatatgtatatagagagattgaatgcaatattcaaactgtacttgtaacataattttattacgtttcaaaccctattaatcatagaatacaaaaaaattcttttctagaatctcatttttctcttatttttcataaaacaaaaagggtaaagccactgggggaaaaatgtgtcttttgttgtataacgaaagtatgacctttaggaaaactcttctcccctattttcttctgatttaggttcattctctgcctttttttccctctctttgtgtgtagtcagttttgtcaaacatatgactctctggaaattttgcagaaataagagttcaatcaagactcttggaattttctatcttggtttttcaaaaatatgcaactctatatgttgatgtagaactagagtgattgaaatatactctttgacagagggtaaagttaagggtaatccactttttttggaagataagaataaaaatatggtttgctttattttgaggaagaccaaatggaaggagcagacaatcatttatttcacaaactctaattatgtaaggagattgattgattggtttttggttgatatgggagaatgattttttttcctgccatgcacagcactgggcagtctagttcccttatcctaagggagtttataatctagtagaggtggtataacacacatacacatgggcacacacacacacgcatgggcacacacacacaataaaaatatgcactattagcctagtaaagtacaagcaaggcactgttggagagcaggagaggaagatgctaaattctcagcgcagtgggagaggttggatcttggggcgtttgagttgactttcccaggaaaatactgaggaaggagaggtatttcaggaaaataaaataaatgagaactgcttagagtgttctcagagactaagcccaatggcttaataggaacaaaatgttcatgacaggtgcaggtaagagttatgttagaaatgtaaatggagacagggcatggaaagtcactgatacccttgtaaagttcaaactgtatttcagagacaattggaaccccttaatatttggccagggtgtgttgaaggtggttgaaaaagatgggacggtgacgataaggaggctcttacaattatccaggagagcattaagaagagaaacccccaagcttgggcactggcagtggaatggagaaagaggatgaatgtaagagagattctggaacaagaaatggtgaactatcatagcgatttgatatgagggcaaaggagctgtagacaacaattccaaagtttcaactaaaaacattgtagaaaccactctattgcaatttcggcaacttttcaagtttgatttatttggagagtatagtagagaacacacattttctgaagaagtactagtcatatttgtcctttgaccctactttttataagacctcctttagtgtcacacctatgaatcatttatttattcaaaaaattaatgacctcctattctatggcaggcataaacaggagaaaaatagacacgatcccatttaccttcacccttccacccatatcctctccccactatctgcccccagtgcttttcagtttggataaggagaaaatatcagtagaaaaactgacttaacccattatatcccttgatctaatagtattttttaaatatgtatttgaaattgggtccatttttttctggatacataaattattagttcctaatctgatctgcaacaatttcaggaaacaattactgaattatctgtgcttaatttgagcagatgatagctaattccatgtgcccagaacctatctttgtaaattattttgattattttttttactagagagatagaagttttgcaggaagttaacatggatcaaggagtggatgacacacacatatgcatgtgcatgcacactgttatacaattgatgaaaatgtcataaggtgtaaggagcagtagaagtttttattagatagttcacctttaaatcctggttttgcctcattgccatgtggattggacatgtcagttcacctctctgagtctcagtttctacatatatacaatgggactaatcttcagctggctgtaacaagaattaaattagataaatctgaaaatgattaacacaactgaggacataatatgctcaataaaaaaatcatttgcaggtcttttgggaatggtacaaactggacctaaatcaagttatattattatagtacgataatttgagttatatttatataatatgaaaattattaataaataattgtaataacatataataatgtaatataatatagtataattaataaaatattacctcctacacactggttaaaagtgttcatgtactattaactctagttaaaatcttcgtgtgtttcttctgatcttagatcaagaggaatctcataatatttgtacatactgcccattctaagtgggctactagtaaatatacaaagaagctgtaataagcatatggcttagtatagaagagaagaaaaaatccagtaaattacgattttcttctaaaaaacaccatctggatgctggttcagctgcattatctcactaatttacattttattttctcaagagacaaaggtatattcaataaaagaagaaaatccagtttagaatgcttgtctctggaacctgtcagctacacttaatttctacgtagatgcagaaatgaggagtttcctcatcaatgtttaaacaaagcatagaattaatcactcaacattcagaagaatcaaagtcaaaatcaaaataagatactttattgaatttatctctccctgcagtttggaatttaatcctgactagaagtcaaaacaaatgcactttttagatgttgataagatgaaaatcaatcaatcgatataggtgttgtattgtattaaaatggcttaatggggttaattaaaaaccatcttagaaataaagaagataaaatacagattactattctaacagtagaagggactaaatatcgtgaagagtcttacagctgaaaactacctagaagctgagtaataacggacatttgaatgacttgctgcgctttcaagaaagtaaaggagatccccaagtttttgtttttgttttgtattgtattgttttttaaaaaggactaggagcagaaagaggagtggtaggagtggtaagtaagagctgaggctcaggatgacttgaaggcattgtgaaaattaatagccataagagaaaatggaagactagaccttgaacctggacaaagatacgtttgaatctgagatgtttgcataaagttagacactaagaaggttatattcgtggtgaaagggtggtccaggaaaaaaatccacctgccagcaaagagagatgtcataaaacctggctatgtccatgactactacaaatggaaaatgaaagtagaactaaaactcagaattcttcttgaggatttgtaactatcgacattgcttctgtggctttgtggttcaaacccttagcacagaaataaaaatgatttcttttttggaactaccctctggcaactgacagaagcaacagtaaatgctgtgtggaggaaacatgcttagataaaataactctcaatacgtatttgtgtatgtagaaaagttatcttttaagagcaagaataaaatagcatgatttcagattaacaaaaactgggtaagtttataatcaacaagttcttcctaatatagcatgcattcagggagaaacacaataattgaaataatatcaaagaggtttataagacaagaaagcttggtgataacaaaggagaaatcaagtgtaaataaacatgactgtataaaataatatgcattaaacattaaatttggcattaaacaaattagatacaacaaataaacagaataccatggcaggtaagctgaaaggtagatgatctaagttaaagcattttaaagcccttatattgtttacaaggagattaaaataatctgtaaagtctagtaaacactgaaactataacatgaattttaagtttgaattgaacagaatagggtcagggataatcagtgaatccaaagaaaagacataagactggaaaaaagagaaaataaaaatgaaaagacatatagtttagctacctcaattatcaccataagcataaaaagactaatttccctggttaaaatacagagattatcagaagattaaactattcaggaaaaaaaaagaactttatactatttacaagatttgtcagaaatactatttaaaaagatatgatgttattagacaatcaaagattgatatgactgttagaagaaatgaacaagtctataattttagtaggagatttagaaatagcattctcactaattaagaggtaaatctaatacaacaaattagaagctttgaatagtacaattaacaagcttgtaatttacataagtatagaaacctgatcttcaaaattagaaattaatattttctgggatttattgaatagtcataagagttgaccatattctaggccaaggatcagcaaattatggctgacagacctaatccagctcatgtcctgtttgagtatgaccctcaaattaaaacctttttttttttaacatttttaatggattgtaaatttttttcaaaaagacaatgtatgacagaaaccacatgtggtccacaaagcctgatatatttactatgtaaacctttacagaaaaagctgactcatgttataggccatagagaaaagtccaatgtatttcatatgtcatcattcaataaatatttatcaaaacccattatatgctgggcaattctttaggcactgaaaatgatagcacagtgaatgaaacagacaaaaatccttctgaggacacttgcattctactgggggaggcagacaaaaagtaaagtaaataaataaaatacatagtgtgtctgatggcaatcaatgttaagaaaaaaaatcagagaaaataacaattgttatttcgcaaaatttaatactcaaaggacatacagtgagccctccatatctgtgggttccacatctgtggatttaatcaactgtggatagaaaatattttaaaaaaataaaacaaaagttacaataagaaataattcaaataaaaatacagcataacagctatttaaataacatttacattgtattaggtattataagaaatctagagacgatttaaagtatacaggaagatgtgtgtacattattttctaatatgccattttttataagggacttcagcatttgtggactttggtatgagaaggtgggaaggagagaggccttgaaccaaccccacaaagacaggaacaactgtaatttattggttaaaaatcataataaaaatttaaaaacacttagaactgaatcataataaaatcagtacatattaaaatccttgagatgcaatcaaggtgtatgtttaattttacatgctatattagaaaaaataaagattgaatattaatgaggtgtaaggctaattgaagaagtaacaggctgggtatggtggctcatgcctgtaatgctggtactttggaaggccaagacaggaggaccacttgaggccaggagttcaaaaccagccagggcaacatagcaagaccttgtctctacaaaaaataatttaaaaaagttagccaggcatggtggcttgtgcctgtagtttcagttactttgtaggctaaggtaggaggatcacttggtcccaagagttaggggctgcagtgaactgtggtcaggccactacactccagcctgggcaaaagagcaagactgtctctaaaaaaataaataagccgtaaaaatatcaatatcagcataaatgagctagaaggaagaaagaataagaggtagaaattactgaagtcataacaaactatagagaaaattgcagaggccacaattcaacaaaaaagttgtttccttagaaatagcaatgaaatatctgctgagattgatcaacaaatatatatataataggagtgaaaattaaaatataaatgaaaacaagcgacaaaaacatttcacatataaaggtaagaaagacttgacaccggctgggtacggtggcttacgcctgtaatcccagaactttgggaggttgagacaggtgaatcatctgaggtcaggagttcgagaccagcctggccaacgtggtaaaaccccatctctactaaaaatacaaaaattagccaggtgttgtggtgtgcagttgtaatcccagctacttgggcagctgaggcaggagaatggcttgaacctggaaggcagaggttgcagtgagccaagattgtgccactgcactctagcttgggtgacagagcaaaactgcatctaaaaaagaacaactagacacaaataaattcggaaacttagatatgatgaacaaataggatccttggggaaaaaagtgtaatttaccaattgtgacttagaattattgtatctggttttgtaaccataaaacaaattaattcagtagtacaaaaactttccccaaacaaagtgacacttattatgcgcaggcaatttctaccaaactttcaaaatcatttcaggattatttcataaaatcattccaaaaatatgcacgtttccaaacttatgttaagaggccaatataatcttcatgcccaaacccaacaaaggcagtgcaagaaatgaaaagtgtaagaatataagggtttttttaacattaagaaatatattaaataattttaccgtatcaaaaattcaaaataatatgctcaaactagaagcagtccaaatgtctatcaatcaactggtaaatgcaatgaaaaggaagaaactatggatacatattacaacatagatgaacctcaaggatattacgctaagtgaaagaagccagatgcaaaaggctacatattgcatgattctattgatgcgaaatatttataaacgacgtatccaaagcagaatagtggtttcttgcatgcagctgggggtaggaacaggtattgactgcaaatgggcacggaggatctttctggagtgataaaatgttctaaaaccagattggttggacaaccctgtaaatttcctaaaaaatcactggattttactacagtggactgaatgtgtacttccaaaatttatgtgttgaaaccttaagccccaatgtaatggtattaggaattaaagcctttgggaggtgattaggttatgagggtggaggcttcatgagtgagatgaatgcccttatgaaagagaccacagaaggctctctcttttctgaaatgtgaatatgcaagaagttaggccttcaagagggcctagaagagggccctcactagaacccaagcagcctggcatcttaatctcttccagcctgaagaatgtaaaaaataaatttccattgtttataagtcaccagtttatgctactttgttataatagcctgaacagactgagagatttatgcttaaaataatttaaaggagacaaagtataagatcatctcaatagaaacaaaaaaaaagtataaaatacaacaatctatgcatttttttaagaatttcaaacaaattacagataaaagagaacttctttaactagattaagggtatttatttagtcttaaatatttactgttgaaacattacaagactttcctttaaaaatcagaaaaaaagccattcaagattatgatgtgggtcttagctagcaaataatttcaagaaacagaaatgaaggttttaagttaatacttaaattattaaatttaagtattaacttattaaatttaagtattaagtattaatttaagtatttaatttaagtattaaatttaagtatttaatttaagtattaaattatttaagtattaaatttaagtatttaatttaagtatgaaattattaaatttaagtatttaaatttaggggaaaaatactaaaattattctctgatgaacttattgtctacatagagcaaaaagaatcttcagaaaaattactggaattattaagaaagttcaacagagtttctgggttaaaacacaaaaaatacattgagtttctatacattaccaaaaaaagtgtaaacagtcttttaaagatacaagaagtgtgtaaaagtgaagtaaacgttataacacttctgaatataaccaaagtattgtatatctcaggcaactacttacttctcttaatagtgctcttttaatcatcctagctttatctgtatttgtgaaaactcataacccctacttagcattagttggtaaatgttgaaatttaagataaccttgtttcctgcaaagcactgttaagtggaatgctctggttccagaacattttattcttcctcctcctcgctgtattcagtcatacatcccagaagagatcagcaaaaaattaggaagttagaggtttacatttgtctttaaaacctactcaaaaaaatatgctttttacaattgctcttcagaggcctcccctgctctcattatctactataattacattataccttctgaaattctatatcaaaggtcagagcagaccctttaggcatgaaatgattcccagctcttcacggactagaagttcaaagtgcaaaaaatataattcactcagtttatcctcatggctccacccacccaggttttttcttacaaacacaccagttctgacaacctgatgttctttaaaccgtgagtagagatattgaagtaaatgagtctaccaggaacagaatttcacattcagaaatattaggttgtattcttcttgagagcaggacatctttttacctttgcagagaccacaaaatctggaaaaataagcactggcagaatgtatgtggaatatgtaaaattagatacgaagtatacaaggtctttcctctgtccccacacctctctcaatcataaaacaaaagtagaaataataaatagcatgactaggtaaactggcatttgaaatacataattcttataaaagccagcatgaccgtggggtgtgtaagagtggtgtttatgttactagcaaagctccttgctcaaagcctggagggactaaacaataatacttcacatcagcgtgatgtggtggagcgatcactgggctaaaaatcaagagattctgggcagttctgaccttggagacggcactgactatttctctgtcacctcaggtaagtcacttactttccctgggcctcttgattttaatacatataaatcgagggcattctaggatcctaggatcctatgccaaggatgaatacactttctgtgctgccaaaagtttgccgacatggtcagctaaaagcctcttcctctctccacattgtgggatgtgtgtgtgtgtgtgtgtgtgtgtgtgtgtgtgtgtgtgtgtgtgtgttgacatgaattatttccatcatttaaaaactcagaaagatggaattgaaagcagggactcgaacagatgcttgtacaccagcgatcatggcagcattattcacaaaggccaaaaggtggaaacaactgctatgtccattggcagatgaatggataaacaaaatgtggtagatacattcaatgaaatattacttagccataaaaagaatgagccaggtgtgatagtgagttcctgtagtcccagatacttgggaggcagaggtgggaggattgcttgagcttaggaatttgagaccagcctaggcaacatagcaagactccatctcttgaacaaaagaaaaaaatgaaattctgatatatgctagaacatgaatgaaccttgaaaacattatgttttgtgaaataaaccaaatccagaaggacaaatatcatatgattctactaatatgagatatctagagtagtcaaattaatagaggtagaaggtagaatggtggtttaaaaaggctggagagacagaataatgggaagttattatttatgggtatgagttcaatttgggaagatgaaaaagttctggagacagatggtgatgattgttgtacaataatagtgatatacttaatgccactaaactgtatacctaaaattggttaaaagggtacattttatgttatgtatatttcaccacagttaaaaaagcagctcaggaagatgaacaaaagtagcttgtgtttgtatttcatgctaagaatgcattctatttctcttttcccaacttttttaagaataaagttcttcagcatgacatcagatggaggggaagaggagtggaggactatttcttgagctactcaagtgaaaggaagtgcaatacttttcagtaagctgaaaataagctggagattttcagtttttatagtcttttttggcctctggattgctagagttcattaacagagccacgttcttggctaaggggccaccgtttttcttgaaggaagtaactgcaccagccactatcagggtacaagacatttatttgcaagaattaaaagaattagcacatctctgggatgacccagttattgcagagggatttaagcaaggaaattgtctagttttctctaagaagaaaaaaatcaagttgtctttacttaatgaccactgatgtagttttagtcatatgtcctgttccagtatatctgtctttttattgctatgcacttttagcaaaattacaagatgctttattgatgataggcacaaatgacctgaaagcttttttttttccttttatcagatgtgggcatttccctcagagacaattctggtcttttaatgaagatgaatgtatcagtgaactttgttatttattgatgactttcctattttctatgatggttttgttgtcactgtattttacttaggttagttatatccatcaacataatcttctttgttggaatactgggattaagatcaatctatctctctgttagttttatgcttttgctgcccaaagaaagcaacatgcaaaacacggccatgttgccttacaagccagatggtaatcagtagttaatagaattggaagtacagttaaggtttattcttgtaatttattcaaaactcaacaactctttaggttagcttgctaatttataactatctagtttttcctaaattcctaaattgaagataaagctgaattcttttttcaggataatagagcatgtattgttcagggttcaatttaggaagaaaaaccacatgaatattatgcaataagggacttactagtgacctaagaagtcatacaatatttgagaaggtagagaagtagagattaaagcatagcatagggagatcagagaaaagtcactacctacccttctgaagcactgaagcctacaaggataaatgagaagtcaggtaggaccagcttctggagagaaactgcagaggaactgttgtgcttgcatctgatgatgggtctggtgggcctggtagtcagcagccctagaggtctggaagaagagctggctgtgcacagggagagttaggacatgctggctcctcaccatctctgaccaggaccatgaccacctgaagagagcaagggcagctgcaccaattcatcctcagagctcccacagattcatactctggccaactcaaaccagagccatttaagttgggggactctgggaaatgcaattcctgcacagccatgtgacacagtacaagccccaaagaacagtgttttcagttgtcacagggaagaaactttagggttagcaaaggcttttcagcttccccagagaaaagctgctgaagagttgaaaataccaagtgttccagcattaacatggtgctgaacacctagacaccaacccactgctggctgcccagcttagagagagagattggcagggctgttgagcaccaggcagttagcctgggtggaaagttttactcagtatggcagggcggtcgctgtcatctaagaccatggaaaatttcagagaccctaagctagagtaaagtaggaccctaagacgacagccagagagaggaggagagccaagcaaaatccccctgggggacctagcgtggaggaggatcctaagaatcttcttcccaaatcacttaagttcgaggtttctgtttattggcagtacttagactggcctatttcatcatcatggtctctgtaacctcttcctccatcactttccctccatctccccctctattactcctccatcacttcccctctatctctctccctttgtctttccctccatctctcctcctccaccactgtctctctagctccctatccaaatttgcccctccatctcctcccctccatccttcccccacctttctccttgtgtctctctttctccatttctccccttccatctctccttcaccattgctctcctaccttcccccatcactctccttatcaccccctgaccccatagtcacttttacatagtaacaagattcaataagctctttgtagtattagaatcttcacaagttgcttcctgatctgcaaaaacttaacttgtactttctttagcccttacatcccaccatcccactcagtctctcttctctctctctctcccctctctttctctcaattgtttatacttcaggtctcagctaaaagtcacctctccaaagagactttctttgaaaacactttaaatgaaatatgttctcctccttctatcccattattctctatcactgtgttttgttctgaaatccttcctgacattcccacaacttaaatgatgtagttgtattttcatggctcctttgtcccacacactacactctaagttccctgaagactggaccaggtccctttatcagcagtgtctacccagcagctagcacaataccttgcacatggaaggtgcttattaaattcttcctgaataaataaatgagtgaatgaataaaaaatgaatgaatgaatacagtcaaattttagagctttccagaagggaaatattaaataagcatattctaattaatttttttcttaaaagacctaagctcaagatggtttcccattttgatttttgagatcaatcataggagtcagagaagcattcataagacagtgagaagcttctaagattctgtcatagttaccagggatcccaaaatgtgtacaacagtggaggaagaggcaaaaaggaaaaatctgcaaatcttgtagcctcagggactccagtggaaaaaaaaatggaggttggtgggagtcagttaaagaaggccaaaaatctggagaccggacaaaacaagttggggaaggaatattgagatctaccaagagaaattccacttgcctttataaaattggtaaatatttctttccttctctttccttttttattttagagagagggtctcaacatccagttgtgcagtcatagctcattgcagccttgaactcctgggctcgagctatcctcctgcctcagcctcctgagtggctgggactattggcgcctgccacaatatttggctactgttttgtttttttttcttttgttttgttttaattttgtagagatgggatctcactatatttccctggctggtcttgaagtcctaggctcaagccatcctctagacttggccttccaaagttcttacattagaggcgtgagcccctcacttggcaaaacttgtaaatctttatggagtgcctctcttgaaaaagatctgaacattgactagtcaagtgcagattaataattatcagcaatttattagcaacctgccagtagagccatactaaaatgaaaatacaattaattggggaagcattactgtgtatgtggcttgctgaaaatttactattttactaatctgtaagagaaaatgcttgaaagctttcatgcatgttatgaataagtttgcccccatatttcaagtgacataaaaaccattcaaaatgaacagaaacttaaaagaatattaattaaaaaatataacgtgaacatatataaactgtgtgtgtgcctgtgtgcgtgtgtgtttgtgtgggtctgtgtgttaaactttttttatctttttcagggactcaaatattttgcaaattttaaataataaatctatgaaaattaatttaaccctagactcaaagaaattatccattactattcaactttatctaatatataattaattttgcacattgtttctaaatagttgcaggtttggattatgatttcctgaaaatgcttcctttgatatttgcttggatgagaaagtgagaactcactcactgtatgtttgctaaacagacctatgtagttaaagagaagctgtccaaaaagattctctatttcagcccaatggagcatattcattatcagatcaaagtgataggattttttttatcttctcctaattgggggtaggcaatttccttactcactttggcaaatcgaaggaatgtcttattgtagagaaagaggctgtgatccctaaatgtcaatgcaaaaaccttcatcacatcactcttgtcccatgtagcacagagaatccattccattaaggtgaattctggaagctggctgaatttcaagctgtgttttaattcaatttttttttggcagacagttttaaagggaagtcaaaggttatagcttgataattgggtataaatacagtcatttcagtgggcctcagattcagtcatgcagaaccaatttttagcatggtgatatcacggttgcatatttttaattgaagcactcataaggagtcctactgtaatctgagtattactacatttttacccctcatgaactcaaagtataagttaatggtatacaatgaaatgttgcattgttgactttatctttcttacctacatgtctcctgaagcatagacttcgagataaaatgttttgttcattggttaaaaaagtgtctgtattctctaagctactaatcaataatagaagtttcttttataagtctgagtgcagcataatttatcactgaaaacttacttcattgctaaagcccaaacatatacacccaagacttttaaatcatgattttcctaatgcttattgtgcatttaaatggtaattttagactatgtagattattatataaatgacaaatttttattatttttacactcaagtgcaatgtctcgtcttaatataaaatctttaaatgtatggtttcttcatatctgttctgctttcttctatttgtaacaaaatgttacttgtggcctttattatttaggagaagaattttaaattgattaagataataatccagcacatattttttaagtaaaatatatgagcataaaagatttgcatggccacattttcttaatccagtctatcattgttggacatttgggttggttccaagtctttgctattgtgaatagtgccgcaataaacatatgtgtgcatgtgtctttatagcagcatgatttatagtcctttgggtatatgcccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtgtcctgactttttaatgatcaccattctaactggtgtgagatggtatctcactgtggttttgatttgcatttctctgatagccagtgatggtgagcattttttcatgtgtttttttggctgcataaatgtcttcttttgagaagtgtctgttcatgtgctttgcccactttttgatggggttgtttgtttttttcttgtaaatttgtttgagttcattgtagattctggatattagccctttgtcagatgagtaggttgtgaaaattttctcccattttgtaggttgcctgtttactctgatggtagtttcttttgctgtgcagaagctctttagtttaattagatcccatttgtcaattttggcttttgttgccattgctggattaagaaaatgtggcacatatacaccatggaatactatgcagccataaaaaatgatgagttcatgtcctttgtaggaacacggatgaaattggaaatcatcattctcagtaaactatcgcaagaacaaaaaaccaaacaccgcatattgtcactcataggtgggaattgaacaatgagaacacatggatacaagaaggggaacatcacactctggggactgttgtggggtggggggaggggggagggatagctttaggagatatacctaatgctaaatgatgagttaatgggtgcagcacaccagcatggcacatgtatacatatgtaactaacctgcacattgtgcacatgcaccctaaaacttaaagtataataataataaaaataaaatttaaaaaaagatatgcatggcaaacttttacaatgaatatagaaaccatgaatagtcattttaccacccaggtttcttgtataattacactacttaaaatgtttagttgctgaatgctaatggtagacttagtcatattgacttagctattggaaaattcatgaaatataagatgactttgtgcctgccatttgggggatgaaatagaaatttcagagagagaattcaagcaaagagacattacaataatttatgataggagttttcatgtttagttttttatactgatggcagtggcggcccatctggaggagccactgcaaagacactggctgcaatggctaggtgcaaccatggctgtgtgctccatagagccagtgggggccaggaacaggcgggagccccagcccctaccaagttgatggggcaggagcccagtgttcctgggtgcaacagcagctgcccgactgtggctccagacctgggaatctctgcactctcggaggcctgggaagccctcctgccccaacaggcttagaagtgcctgcttctgccccctggcctctccctgctcccagtaccctctctgctgcagagcaaagttgtggctgaggctgggtgctgttgcaatgtggccaggtatgtgtattctcagaggtgctgacacgccagccccctgctgccttggccccctctagactttgggaacccaggagcatgggagggaagcaaaggaggggctgagggcagcttagtgtgggcctgcaggtaccccttggcaggaacagcctgggcgttgtggatggcatgttgatggcagcagaaggcagacaggctcctggacaaaaaggggcaggtccctggtgaaatcccaccttcaagcctgaagcctgtgggctgggctgccagttcctgatgaagtctgcagcccagagtgagaacttatggtgctttttctggccctgcccatggccacctatggactaatcagcatgcacttcctcccttatgagcccataaaaaccccagactcagccagacttgaacagacctcaggactaccagctgcaggaaggagctactgcctacgagtctcctctctgctgagagctggacactcttagggatgacctgcttgtggaaatgagcttcccacttcgggtctcctgagggctgttctgtcactcaatggagctcctctccacattgctcatcccccaattgtccatctatctcattcttcctggatgtggaacaagaactcaggacatgccaaatggctgtaacccaagcagaactgtaacaaacagggctgaaacatgctccccctccttccatgttgcaggcaatgagaaggagagaagagctgcatcccttcagggagtccagacctagggaatcccctagccagagctgtgacaccctctttggggctctgtggttcctggcatctccaaggttccagatgccactatattcccctcatctagacatgggtacacacagcagaagctgtgtgcagtacatctggtccagttacagccttgaatggagctggcacctgtgccagtgtctggagctgcccaccctactgccacagcctgcatgcctggctgtgcacagtgaccagaccctgcactcacttgcccacacacctctcacttctctgtgcctggctcacctttggtaggtgtgggatccaggacagtagcgtgagctgagtgcagcctgctgggccgagtgggtggaatgagcccagtgggcgtgaacaatactcaggcagaaaggtttctggctggcaaagagacactccatagatcccatgacaatactatttgaattgtgaggaaacaccagattgttctagaaggttgaatacgcactggtccaaacagatttcttgccttcctccctgcctgttgggggtggagtggaaaggggaaggtgaagattgtcattgtgtatgcatttgttttaaacctctgtagcctgactttccaaattgaaaaatacaactctgccattctgtgttcacacatgtcagagctgctgcagaaaactcctctttgactcattcatcgccattgaatctgaatttattttcagtggtatcctgacaggaactttaagactgaactctgcattttttctgttttcccagtcatctgcctcattctatgttgagggtttcactaatgaatgtgatgtttgctggtaaataagtaaataaatgcacctgtacaatttacttccttttctggaaagacagaaagaacagaatactagcacaagaaaactttttttttccctcctcttgcttggttctacttcagctcagttacttttgacaaagaaaatgaaaatttaaatttccattgaatgaattggtgtcatggctattatttaagagtatagaaattaaagctgcaattgggtcgtgtatcatttgcttaccctagatgcacattatatcctggtataatgaaaaatggcatgcttttttttttttctttctctgtagtgaaccataactgaaagcaggaagcattggtttacactttgcatcagagttgtgggatttctatatgggtacagtagtcagaatccattctaactgtgaatgccagaaacttaatttctataaaatgtaagaaaaatatgagagtgaatgtactgcctcaggttacttaaaagccgaagcagtgattgtgacttcaggtaaggcttcatccaggcataaaatgattgtcttcaggtctccagttctttctctccttccttctcttgatattgtattactttatggggactgtctcatgcaggtacttctcagctggcaggaaagatgcctctaccactccactctaaagtaaccttagtagtggctaccactctgtaagtgcatcttatgggcatccttcttcaaactttaatgactatgaggtatttacttaatcctcacaattattctgtgtggttatgacatttgtccaaagtcacagaattataaagattggaagtggatttgcctagctagtttggctccagcacctatgcatgcatataacccttgctctaagttgttacgctagagcttgagatctacagaggagaaagatgctttctctcttttaacctccctatcaatcctgaaaatgggatctgatgtctctgcatgagtccttgctcaacctgcaccaatctctgtgtcctgcacctcctcccatcagcatatgatattcatccacaacagctgaggggcaggttcagaagggaaaatgtgcatggcagaataaaatgttacaaatgaccactacagcaggccaagctgccaattttccagaaaggtccctggcattgcaatgttccatatggaaagcagctcatctgggtaagcatgcttttccatggctctctatgctttgtggtaatgggtagtgaccacagtatagcaggggcaaattgaacagctgaagaagaggatggaagagaagacaggactatgaggaagcataagggaggattgggcaagatggaggcagacatggtgtggttacctgagcaaatactgtagctgctaaaattcttagataagcctgaggttactttaggctcctatataacctagattgagctaatcagaatttcacacaaaaatccagaatagtgattagttacctttcgtgagagtattgactggtaggtggcatgaaggggctctctggaaatattttgtatcttgcctagggtggtggttacctccatgtaaatatataggaagttatcaaatggtacttaaaatttgtgcactttacctcatgcttgtgctagcttatttttttattgacagatataaacaattctacctgtgcagagacaagccagattgtttagtaaattaccatccagatttcctggattgcctagttaacaagctacttggaatcaaagccccccactcctcccaccctctcccggaggagtgtctgcacctgaacccaagtttcacaaattgccagatgctagcagctaacactcccagacatcagccctaaaaaggtggcatctgggtgcagactgttttgcactcacccccagactgtttttaccctgcttacaagacagctctcttctcattctaaataaaggaaagtggcccttctccaagaacagcctacggtgcatccagctggcccagccccaaggataccagtccacaggatgctgagagcacagggactctgggtactctttttccctcctacctatgaattacagcatgctgcaagtgatgctattaatgtgtttttggcattgccaaggtcattcttactaaccaacacctaggccttcttgcattttgatattattggacaatttaaagattcccaaattgcatctctgcgttaatgtgttagggatgccatgacaaaataccacagaccagatggcttaaacaataggaatttattttcttacagttctgtagtctggaagtccaagatgaaagtgttggcaggtttggcttcctctccttggcttgccgatggccaccctcttgcttactcttcatatggtcctccctttgtgcacctgtgcccctggtttctctcgcttttgtgtctagttcttataaagacaccagtcagattgcattagggttcatccaccctaatagcctcattttaacttaaccccctctttgaaggccctatctccatatacatttatattcagaggtactggggcttggggcttcaacatgaatttggggtgggacacaatttaatccataacagtctgttttgctggaatcaactacaatgactgttgattacaaggaacctgaaaatacttttttttatccgtttagctttttgctcagtctaattgaattcgtagaaatttagatggggtatagttcaagctaattatggtgcctgtgcacccagacaaattgtggtacaaaatctaaacttctatctggtgaattaaggataagtagaaaattaatatcatgtaatgtttgagaatttcagaaatgaattcccctttatttcatttgcagctgttagcctggaggaatttctagttcaacagacacaccatgcacgatcatgtcactgggcctttgcatgcaccgtgccctctctgggaacacttttccccctatagctaattacccagcttttctcttctctagaagctagttttgtccttacatctaaatatctacgctccgtggttacaggccagactggtgtcaaactcctgacctcaagtgatccacccgccttggcctcccaaagttctgggattacaggcgtgagccactgcacatggccagcatacagttttaattcaacacctcaaaatggacagcatcataaaattaagaaaatgtgatatgttttttctagttataatcatcatgttctaagtgcaattttatattccaattttttattaattatgtcgtaaacattttctgtgttactacagtgacttcttaatgattttatatgcagtggtcccattaatttagtagaataaaagttacacatgtttttattgtgcatttgggctgtttttcattacagttgtccctctatatacagggggaccttgaccacaccaaaatcagagcagattcaagtcctacagctggccctgcagaacccgagtatagaaaattcagctctccatatctacaggtttcacatcctacacagactgtattttcgattcacgtttggcggtggatgcagaatctgcagatacagtgcattgattatatttattgaaaaaagaaacctcgtataaagtgggccttgccatttaaacctgtgttattcaagggtcaactgtatttgcaattatagctaatgctgcaataggtatcttcttcctaataatagctattaattaatagaataaaatatcaggattcaggttgagagacaggaccatattgattactctggattaatattgtcattaatgcttgtccaaagtactcaactgccaaaggccaacagcagtgtgttggggttatatgtctatccttttggattaaatgttaagcaatgaattttagaaagtgtgtgtgtgttttccttccttttacatatactatgttatataacctttttttgctaattctaagaccggcccgttagaactattttgttgttgtatttggatagcatgcttggattactatagatggtgttccttattttagtactttctaggaatgcattttgatgtgaattttcacattcaagtctgagaaacattcctcttcctgttgccttatatttttacacatctcaccatgtccatcccttgactttgctttttattgctaaattcaattcctcttggaaatgacgggcctctgcatttgcagttagttatgcctttgaagaagattatttgcctcccttgagtttgtgatttcctaaatccagtgaatgctctgctcaaagaaagtttccttttgttgagaatcaattcatcactttgaaaaaaaaaaaaacttatgacaaaataggtggtcagatcatacccctagagtacaggaccttcacatctgttctgctgtagaattgagtagaatgaaaatctgaaaccagatttgtggttagcaaaagaacagaccctaaaaggcaatagtctaagtaaaactctgcatccaatttttattgcttctgctgttttgcttcagatatcttttcatattcctaagctgtcttcccatagtaacaaaactataaattcatttagtgggggataagaatagtggagagagggaggggaataaaaaatcaaatgggttgttggagcaataaagctattggtaagtttaatgctgactttaatctccagggtaaatgattgtgcaattgtgtcttacatttacaatctagtgagctgtgaataaaggtggtggggaaatatgtaaaaatgtgggccaggaaaccagctaacaaggtcataagctcagacacaaagaacctagttgattttcctggggcggaagaccctgaatccaggatattctaatcttggctcattagaccttaatgagggaagaataatttatatcaataagccaaaaatttatcttttctggcactcagagcacaggagcattatttataacttagaggcatgcaggtgtgttcccctaggcatctctttctatcaatattttaggagacttcctgatttgccgtggagaaaaactggagacatctggtattgtgtaggatggttgatacttttacaaaattcattcattcacatagcatttctttactcattcatttaatcttctggcgctgacatggaggtactctatttaggatgtgttcaccgtaagggtacatcttaaacatacctatgctttcattgatgtgacgtctataaacatgtacagacaggtacctgcaggtaaatggacaaattaaaatatcattatgagctacatggtcaattcatcattttttccagtcagaagctttacttggtttactttgttgtaaaattgtaactgcttttgtacaagctgccttctgtcctcccattctcatttccaccaccatctatagaggtatttggttgcatttcttgcctttattagcccacatggaatggtggccagatcccagaacttcagaatacacttacactgcttgtgttaagtaagagggaagataatgcagtgaatgggaacttgttgtcataaaaataatcacagaaattctacattcccattcctcagcagttaaaaattggatcttgccaggtatgatggctcactcctataatcctagaactttgggaggctgacgcaggaggatcgcttggggccagaagttcaagaccagcctgggcaacataatgagatgccatctcaataaaataaaataaaataaaatagttaggcatggtggcatgcacctgtagtcccacctacatgggaggattgcttgatcccaggagtctgaggctgcacactagcctgggcaatagaacaagaccctgtctcttaaaaaaaaaaatagatcttatttactatattgcactcggatagttattctggattatcctttccccatgccccatacctctagtatatactcaaataaagctattctttctgaaataattatcttttatgcagaagtgaagagagcagagagtaaaacctcctgatgtccattgcaatggctagaccagcaacattgtcttaagcccaaaacagtaggcagcatccagaatgataggcttgtggtgttcccaatcacatcctgaacaaaagcccttgttttatcacaccacaaacattttcacaagtgtgcatcttcccctggaacagatacagccactacctggaacaagatgaggataacctatcaaataaacacacagtcactgcatgggcctggagccccaattcttaatggcttaaaacgaaggagtgtcaaactcaactatctgctggaactagactgggtgtgaggcaggagggagtgggggatgctgcataaagttaaagaacccaggccttatttaaagggatcagatgctactcagtctgaatcattccggatagcgaatgtttcaaggaaccctccccttttaaaaattattagcaacaaaaaattcaactgtttataatactgtgcggaccaacactgccttagacaaatataacatccaaaggaatagattgggcccatgagcttactgcccctgcttcatgatatcctaactaaaagtaagctaagagaacaattctatctttaggggaaatactggggttgggtgccttcccatggatttgtaaatctaactcatgtcatccccttcaaaaggaatgacctgctctgtccactgccccctgtttttacctatcaatattttacccacatgtgtcagtcagaacagggtagttgctataataaacaaccccagcatctcagtgacctgataaaggtttatttctcattcacacaaaggccaatgtcatcctcctagttgagtgagtctcctgtaagcagtaaacttggggatttagggtccttcaaacatgtggttctaccctcccaagtcctccacttctagacatgtggacaaaagagagaaaataaaggataacgtggaatatttcatggctggacctgagagtggccttcacagctttcatcaacattggccagcactcagccacctgatctcagccaggtgcgacaattctgggaaatgcggtcttcccagttccccaggaggaaagtatcaagttagttttcacaggccagcttaaaaacctcactgatccaagagcactctctgataatgctaattagaaatacgcttgcccttccattcaattaatatatgtttaaaatacacctgcaagtcatattgttggccctagagacaaaatgataagatgacctccatatctttcgggagctgttgtttcagtagggaggcaggcattcaaacaactctatgataatatgatgggagctttaatggactactaaatacagtgggggcagatttgaagaaatgctctttaaccatgtggagcttgacactttgttgattgcatgcacatcttgtcttgttactgtatcataggatccttaagtacatagatcatactctatttatctttgtatcctccctattaccagacatctaggggttcccataaacatttgtcaaattgatgaatgaatgagtttctgatgaaaagggaataaacacagactcaccatttgagaagaaaataattagtctgtcagcttttaatagtttaaacttttggtacatgagataatataatattcttttgaattcttttctttctgatgcctcgaaatgtctatggtggctcattctatgatttccaaatagattatcttcaaataattcacaacatttagccctaaattacagtttcctgagtgtgtaacaagtggtgatttcatttaagcaacatgctgtatcatttatctgggctaaagtggatcagattaagtttcaaggcaattatgtcatatttttggtgagtatagtcattattagcttaggaactctttaaaggaagtcagtttcaaatgtcttctgcctattattaaatttactacataattaatttataaatataacgacttagatggtctgataacaaagttaaaattaactaggctgtcccttctttgtattgttggacgtattcaataaaagcaaaagaaatctcagtttctaaactatgaaccagaggccatcctcctgcttagttcagagtcgactaatctgttgtttgctaaataagtcttattctaacagcaatactagaaggaaatgagtttccaccatttatcatcaagtttcaaagtggatattcaaactcctgtcgggaatttgggggagaaaacgtttaggaatgcagtattatatatcactcactcatgagaaatgactccttgtttgccagcctaggaatcaaacttggagccatttatgtcaacaaaagactggggtatgtgtatgttttcacagatggatggagagtgaatgtaaaccaaagacaatggggtctttgcctgaaaacctgcctttatgcttatcatgcagtgaaaacaccttttttttctggagcgccctgaactttgtctatttagtctgggcctttttgatatattgcttcacattttgggggtatctgctttggctgtgtggctctctatctagatttgaaagttatttgttccacttgttctttctctccttcatcatacctggtggattaggcagtcagcagacgaactagcacccaggttctgttcacctgcacacctgctttaatgcatttagcattcagttggcaccagattctagacaaccttgccctccaatgatctgaagtctacttttttcttttatggaatattttaaaatatcagtgtgtgtgggtcttgtcttcataattgaattctaggctccataaaacaggaactgttcactgtatttcttccggacttaagacagcagcaaggaaacaggaagtgctaaataagtatttgttggagatggtatacccaaatatacaatagtatatgtatgaatgcattattgggttaaatctggtaaatctggggtctgggattcaaaatcctggacccatgaagtagaataggaaaaaaaaatttttattgttcactaactactaactgaaatttatatgtccttcaatgatgaatgtagtccttgaactccaaaagttaacagcagtgcctgaaacttggcctcccatggaagtctcaggtatttttgtgtcacactccacttgcggatatcttagaagtctcatttgtgttcctaactgcttcaaaagtatgctagctattaaaacttcaactaaattttattcatgtgctaatcatgacgcatattttaacatctgataagtttttaaaatatctatgcctattttttaagaagcatattttagtataaatcattttctttgtaatcctatatattgtattttattcatttggaaacactactatgtgaacagtccatagcaccaccaaactgccaaagagccagcgacatgattgatggttgagagccactgcttcagatctcactggcacataagctagttttaggaggctgctttggagtccagtgaactggttttagaagccaggattttcattttactgactgtgtgactttaggcaaatgacatttcccctttatgatgacccgaggtcttttccagctgtgaattctgtgatacttgttttcagacatgttaaaatatgccttacatcaaactcaataattttattaagcacttgaacacacaaaaaagtaaaaaagattcacaatataaataagttttaaaatggtttagataaatccttggctaatagatctattatggatcaactaaagtcagcctaggaggaaaggaaccttgtatgcacacccagcatttaaggttactggacaatgagacagctgtccccatgcacaacagggaccatttcaatatatactggaacatctctcaatgataaccaacagcttttccatggacattcagtgtagttaaggagaaaattagccatattttccttcagtgcctttgattaaactctgatgatgttttctgaaaaggaacatcaaaaactaggacctctggagacagacatgttgtaattattattacaaatacttagcatttttatcatcatcattaattacatttctcctttaagggtttatcataatctccaagcctgctatttgttcatttgttcataattatccatgagtaagcaatttgttctgtgttctcagaaattggttgtttaatatttggttcatttttaaaaattgtttcacaagggaggttcaaaaaagttgtgtttttcttcctttttcttctggtattaaggatacttctgatgtccttaattatcctggattctccctccatccatcccctacacacgaatgtaatgggggctttcagaaacacaatcgtaggatttttataaaattcggcacatcaatctaggaaaagaacattcaatggtaagacagccatcatctttgatatattaatatatttttgcataaagtcctcactttctcatataaattattccagtcttatttgacctttgttgtcgaggctgtctatcattgacaaagcagaactgaccacttgcctcaattccgtatcaaagtttattttccttcacctccctctgcccccagttcaatgctgaaaaggagccaggggagaaagaagtagcagatcaaaatagaaaatacctactttgtgctcaaataacaataaaatatccataatggcgtgtgttcaaacctctgtatctccaaagagtcgagcaacatggttagtatattaacctattagggttagccgattctaatcaggttcagtgtctgggcagggccctctgttttttgtgctagcagtttcccttgaagccagactatttagtggattcagcactgttcattttgtgtgaaagcccgtattcttctcttcatacttttcaaagatatgcttttctcattgtaagcccaggtcataagatgatgcctcaagtgcattgcgaaacatttattattctgagagactcaggtgatgaaaactctatgtgtttggtgtgtgattccttaaatgagttgtcatttatgacaatgactttatttataaggcactgttcctaagggaatatgagttttttgaccttgaaatacatgtagccaatctgcttggcaatttgtaattgtcccccctaaaatagtaagaacttactcttgctctttttttggaactatattcagccttgggcagtaaactataactcagctaaagttacataaaccctgaagggaaataaatttcaccactgttgattggtaaatgtcacagacatcagtgctatttatcaaacatttctggtttcctgccatttagcccaaagataagattttaatttcctatcccctttagggttcagcatggtcatatggctggatttggccaatgacatgtgggtaacagtgatatatttcacttctgagtgaagggattgagagctaatccatgatttatcatgccacctttttcataaggtaataatgaaagcacctagccaacttggagcctccatcaggctgagtccctgcatgactaccatgaacagggcagaaaccaggacttattttttttttttttccatgaccaacatagtgcttggcatattattaaaattctagaaatacttataagtgtatgggggtatatatgtatgtgtgtaaatatatgtgtgtatgtgtatatgtatgtacacgcacatacacagagagagaaagagagaagctgaataatttttctgagaatcaaccggaattcgggcaatctagcatgaaaaatttcacttgtagctgtgtttgtttcccttggtttcacttggttaactcagcatgttttataataacatcataactgctattattgactttattctaaaataggctattacaatttctgagtaactactttaagctagtgtgtccctcctttttgatgcctccctggctgcacttcggtcaggctggaatatgagaattcagtaggtgaaggaaaatatataaagagaaatataaaaatatcctggtgttcaagaaataacttaagtacttatatcttgaggagaaaatacagatcctcttcagtgcattagtcatgtaggtataataaatgagaaagatggaattcaggggacctgagatcattacagtgttatctcaccgagatgattttttttttccaacggtagaacctcctggcctgatcctattgaagaagaggagataaattgctctcttttgaaggtgcattaaccttaggttcatttaatgaattacctctcccaatgcactaacagataccctggggcctgagatgaaaaatggcctctcttctcactgagaggctcaaatacatactacttccttctttctcttcaacttgttttgactttcattctttatcctcttgtgatgtatatttaacatataactataatgtactctcagtttaaaaataagaatgggaaatctatcccctaacaagggcagtatgtgtttcttattttaaatagattctcttaacttaatttcttgattttcttaacctcattttctcctctggcatcttatggtgcaagctacctgccattcatgattctccaagacaccttaaggaaaggagtgctgggtgataatacagtaggtgctgcaaggatgtgagacgtgtagttaaatggctcagcagatgagctcagtgctcatcccatattcatagtcccctcagtagaggccattcaactgaatgctcttcctcttcctcctctgtagaattacctctcgagcatcattggatcgtgcattcgtttagaaaatatgtataggtaatcatcagtctttgagttcctctgaaatcagagcctgagataagaatctgggactattttaaagcatagatttcattattcaggtattatgaggccaacaggtcaggaggtaaccagcattgaaaagatagtttgttactcacagttcctaagaagagggggcagccatgccctgtggggccacacaggatagcaccaggcccagtcagcaggcaaaaggagtgaggggaaagggtgcacaggaggccttagagtggtttctgcaggaaaagccaggcaaggcaggatacgcaggtttagaattggcatttagggaccatctctagtggtctggtaccttgccctgggataattatgggaaagaactattgacccctcatgtttaagagtcatatagttcagagtatgcggtctggatgggttggtttggatatgaaaagcatgctccccagggctcatttgctatctctaagaactgactaaccctgatagaggccatccctccttggtcagcaaggccgcagtgccaaattatcaaaaatatagaaaactgtatacatagttaatccagggcacatatagtttatttgggaagtgatccccagaaaacaaaaatgaagaagtggggagagtgagacagtgaagcctggggctcatttccactgaggttcctctgggcaactatgtagaatgtacctcagaattgtccctacagagaacaggaggcagaagtatttattcactgactcccagcccccagtggttgagggttgtctgcagggacattcacatctatgcacttctgggatgagctcacacacacaggctgtgcataaggcttcagagaaagccctgagatagaagatttgattgccctgaaggcatttgaggtgggaagccattaggatgccaggaacagttcacctcttgactgcagttatagtgaagaggtgggccaaagggtgtggcgtggggcagccaaaactgtgtgctgcagcacaagtccccgaacccagcccttcactgaggaacatcaaagaagcctgctctttgagatgtaaaccataagatgatcaacacaaaaggggtcagagcagccacatacaaagtcaccttaaacgacaaatgaatcccaggctgcagggcataagccattccacctgcctaaagaaaaaaccctctgccaatcagaaatattttctgtcggctatgaaaacagagaaagaaaaaaataaatgtgataaatgttattatgcctttctgagcattgcacagggaagataaaaccccagctcaaggattaggcaggaggtagggatatcttcattttgaaggtgaaattttgcctgattcatgaagcatttaagttatataacaacaaccaaatcatcaaaaatttagaaaactacacatatgtgtatatatatatatatagagagagagagagttaatacatatatacaactttatatagttaaataaattatataactatatgtgccctctattaactatgtatctatctatctatctatctatctatctatctatctatctatctatctaaaactctctctctctccatatatattagtttatttgggaattgatcccagaaaatattaatcctctcttccctttccttcccacctttctcattcttccccttttccgtctcctctgtcttcactccttcctctccgcctcttcctttctgttcataactctcattgtttgtacatgtaacttggatcaccttctgggttggctttccaacactgccagcaagccataacatcaagatagtagctctctgtcaattacattttaattcacaaccttttcataattttcacaagaacaagtacaacggaacatcaaatctttcaaatcaaactgttgttcctttctagttggatttacattaaaattgtactgtgagagtgatgtagacctttaacaggcaaatgaactagaagacataggcaaaaagtgaggcaaacgtgctcctaccagcaccacctctgccacctcatatgtccacacacctgggcttcaagctaagaagcctccagtgccaggcatcctgctaatactcagggatcccattatcacttagccataaactaaattattagtgacatacatcctggattactctgtctgtatctcactccatacatccagacactgacacttaattatgttgttccacagtagatcaagttttacagcagcaacaaagattaaaactgttttatattggggacatttagaggataaacagcagagggttctaggagagaactatagtcagctttgtggccatctgggagaaaaccattcaagtgctattaatatttaaaaaccttttagatttttatagtttgcaatgttcctaacaaactgatctctaactccgcagtgaatttttggtgtcaaaacacactgctaagctatttctgagtctttattaacagagacagagctgtcagctttgtgctgtcctggtggcctggttgaaagttggtgtcattgaagaagcaaatctgagttttcggttgtgcatgagaatacgtccactggtcatcagcaggctctaggtctgcatgtttgtgtagttacctcccatcttctttctcttctctctcctttattctttttctttacttctttctttatcttgttttcttataagttttctgagtctatagaaatatgtattagagtattactttaaaagaagttcttccaaaatctatatcaaattaacttggcagaaagagccatagttgcttcttcccaaatagctctttctgcttgaactgtagtatagtatcaagacagacttcagagaaaagaatggtagctaacatacagttgatagaactgggagatgcttggaaggctgaggtgggaggatgacgtgaggccaggagtttgagactagcctgggcaacatagcaagaccccatgcctacaaatataaaaataaaaaacttagccaagtgtagtggcacacacctgtagtcccagctacttgagaggctgaggtcggaggaactcttgagcctagaagtttgagactgcagtgagccctatcactgcactctagccagcctgagtgacagaacaaaaccctgactcaaggaaagaaagaaagaaatgggagatgaatgatgaataaatagcctgccgtcttgcacgctggctcccaccctcatcctctcatttccccagccccgctgtcactccttcattctcctactctcacagccctctcttggtggttatgtacaaaggagcgggtgagaaaatctccaacctggtgtctatagtaaaaagcagcatcaggtattggcagaatcaccagattagtaatgagatgatggttgctgaatctttccatgcttcaattgggggagaaaattgtttatactgtgaaagtttaaaagaaatcaggtaggccaggtgtggtggctcacacctgtaatcccagcactttgggaggccaaggcaggcagatcacctgaggtcaggagttcaagaccagcctggcaaacatagtgaaaccctgtctctaccaaatatacaaaaattagccaggcatgatggtgggtgcctgtaatccctgctacttgggaggctgaggcaggagaattgcttgaacccaggaggcagaggttacagtgagctgagattgagccactgaacttcagcctgggtgacagagcgacactctgtctcaaaaaaaaaaaaaaaaaaaaaaaaagcttcttccagaaatcagtcaggtaaagctagataataaagggaaggaaaagaattgtatcaaccatacagtgttaaatcagagtttattagtgttgttatggatgaccttgattacatgatttcatgcatgctttaactgattcttatttgtgtagcattatttttaatcttctactttgaaaacttctagacttacagaagggttgtaaaaataacgcaaacaattctagtacacccttcactgatttctcagtgaaatctatctttaccatgttttttaatcattccataacatcaataatatgtatatattattaactcctgaattatttgaggtaacttgcagagttggtgctctttacccttaaatattttagagaatatttcttaaaaacaattatattacataatgacagtaccatgaaattaacattgattaaatgctattatctaacctttagatcttagtattccttatttttttcactaatttctgttacagtggaaggaagaaaaacacttttctagtccaggatccactccagagttactgtttgcatttagctgtcatgttcttccagcctcgtggttcctaatccttttttctttcataatcttgaaatttttaagagtataggcaaattattttgtaagaagtctttcagttttaacttttgtggtattaaagaatcgttttctaagcaatggggaaaggattccctatttaataagtggtgctgggagaactggctagccatatgcagaaaatttaaagtggaccccttctttacatcttatacaaaaattaactcaatattgattaaagacttaaatgtaaaacccaaaactgtgaaatccctagaagaaaacctaggtgataccattcaggacataggcataggcaaagattttgtggcaaaaacaccagaagcaatttcagcaaaagcaaaaattgacaaatggggtctaagtaaactaaagagcttctgcacagcaaaagaaactatgatcagagtgaacagacaacctgcagaatggacgaaaatttttgcaatttatccatatgacaaagttctaatatccagattctataagaaacttaaacaaatttacaggaaataaaacaactccattaaaaagtgggcaaaggacatgaacagacacctctcaaaagaagacatacttgcagccaacaaacatgaaaaaaaagttcaacatgactggtcattagaaaaatgcaaatcaaaaccacagtgagataccatctgatgccagtcagaatggtcattgttaaaaagtcaaaaaacaacagatgttggtaaggttgcagagaaaaaggaacgctgttacactgttggtcggagtataaattagttcaaccattgtggaagacagtgtggcgatcctttaaagattagatgcagaaataccatttggccgagcaaacccattactggatatatacccaaaggaatgtaaattattctattataaagatgcatgcatgcatatgttcattgcatcactattcacaacagcaaagatatggaatcaacccaaatggccatcaatgatagactggataaagaaaatgtggtacatatacaccatggaatatgacacagccataaaaaggaacgagatcttgtctgttgcagggatatagatggagctggaaactgttatcttcaacaaactaatgcaagaacagaaaaccaaacactgcatgttctcacttataagtgggagctgaataatgaaaacacatggacacacgggggaacgacacacactggggcccttaagagtggagcagggaaagggagagcatcaggaggaatagctaatggatgccgagtttaatagctaggtgattaggtgattggatgatctgtgcagcaaaaccatcatcgcacatgtttacctatgtaacaaacctgcatatcctgcatgtgtacccctgaacttaaaatagaagttgaagattaaaaaatgaaaaaaaaaagaattgatttcaaaaaaactaaaaatataacatacaaatataacaagaacatacaacaaatgcattatttaattcattaattaataaggaaactagtaagatgttaaaatcagtcttaaggagcatttgaggagctaagatatatggcaattttacccgagatgttagaataagatttctggcttagatacaaaattggtgaatgtcttagaggaccataaaccataatccttgggattataccttccattgaaaagaaataatttacatctctactggacaaaaatctatgggttaacgtctgcattctaagagttgtaaagtagtccaatcagtagtaagccaagccaaacactactctgcaaaaacactttcacctgttccaggttttggatatgtttttgacagtggtttttaaattatgtttcattgttggccaggactgagcagagggaaaactgtgaagaaggtacaatatgtacttgaaatcaggaagtacccacttcagccaccccataatatttctctacccctcccttctgccttgaagtgcctgagtcttatccataccagatatgccactatcgagaagcagatgacaggctcaggccttaccagggatgcacttgccacattttggaaagactacataaaaaacctttaaaaattggagccctttgggcctcaggtatccaaagagcacattttttggaaactcaacactcaggaaggtcgcatagagccagtttatgcaggtgagtattttgctcactcttataaggtccttataaggtcctcttcatgtctggtttggttctccttttcatgccctggtgagtttccctgttccccatatatgagtgactcttttttaaggtacctttaatcttttcttcatttagtttgtcagttaaccatgaagggctttttgctcaaagtttggtttcaatgttcatcataaaaatgacatcccaaaggagaaaatttacttttctatattttacacaaaaagagaatactagtaaatattgctaataattaaaatagtatatatatatatgtgttttcatagttttatagatttttaaacattgaatgatattcttagcgttttaaacagattatatctcattattgtgtgttaccattaggcaacaatgaaatgtttaaaatatttttaaagtattgtattttagttgtatcgagacatataagcctttcttaatttaggggaacaggaataagactacccactagacaattgaatctctggcctacagccaaattttacagagtttagatttaatgcttatcactttttttaagtgattattctttttaatttccctaagtcccccaaattagttttttgatatttactttttctgtgattattttgagaagtttccaatctttattttattttactttatttttgagacagggtctttctctattgcccaggctggagtgcagtggcatgatcatggcttattgcagcctctgccttctgggctcaagtaatcctcccatctcaccctcctgagtagctgggactagaggtgcacaccatcacatctggctaatttttatattttttgtagagacgggtttttgccatgttgcccagcctggtcttgaactcctggactcaagcaattttcctgccttggcctggcctcctttttttttttttttttttgagacggagtcttgctctgtcacccaggctggagtgcaatggttcagtctcagcttactgtaaactccacctcccaggttcaagcgattctcctgcttcagcctcctgagtagctgagactacaggcgtgtaccaccacaccggctaatttctgtattttcagtagagacggggtttcactatgttggccagacaggtctcgaactcctgacctcgtgatccacccgcctcagcctcccagagtgtttgaattacaggcatgagccaacgcacccagcctctcagcctccttaagtgctgggattacaaggtgtgagccactgtgcctggccagaagtttccaatttttaaaagttaaggtagttcttaattttctaattataagcattgccaacgcgtcagttctaagtgaatatgtttattagaaggcataataaaaagcaaaaattcgtcataaatttactgctcagagataattattgcttacatttgacacttggcatttttattattttttatacctatttatttacatttgtatactagagatcactggatatacaactgagcgtcttcatgttttcaataaaatactatatcattagtattatcctgtgtaaactttctcataattattatttaataatggtataatattcctttgggttaatggactataattcatttcactgctcccttgtggttggcagtttattttttcccaatttctcttttgtatagaatcctgtgagggcaatttttatgaaccccacaatttacatttacaaagttatttccatagaagagactccgtagagtgtagcaatctgctgggaactagaagcatatcaaaggctcttgacatgtgactccaccagtgcttatgtgtgcttatctcatggcctcctgactgggttcgagtttcatagattgttcagtcttttctaatagttgttttaaatttaatgtcattgaatagtggcttcattgagcattttttttcaaatgtgaattagcatctggacttctttttttttttttttttgtacgtgatctacatccttttagatagtggcaactggacagatgtaacattaatctgcactgtaggccaagtgcagtggctgatgcctgcaatcctagcactttgggaggctgaggtgagaggattacttgagtccaacccggccaatatagagacctcatgtctacaaaaagttaaaaaagttagccaggcatggttgtgcatgcctatagtcccagctacttgggggactgaggtgggaggatcactctgagcctgggaggtcgaagctgcagtgagctgtgatcgcaccaatgcactccagcctaggcaacagaaaaagatcctgtctcaaaaaaacaaaaaacaaacaacaacaacaaaaacactgtgtaaatgtatgtatgtgtgactccaggtgacttatttaacctctttgaatttccattctttcatttgcaaaatgacgataataatgaagacttcacagagtagtaagaattaaatgagatattataagcataatacttagcacaattcctggcagtggtaaagagccgttaaatgactttgttataattgttactaaaattataattaacattttttcaagtatctattggggaaatagatattttctattggcgtacatgagctttttatggattaaatacattattcatttgtcatatttgcttatggaaatattttccagtttgttcatgctgttttaaagtttgttaaattattttacctctgtttctgtgttttgtcaaaatgaggaccaaataagttgttacagcacttaacagaaacaaaaagtagccacaaccctttgggcatcctctaagcatttggtcattactatcattagcatcaggggacaggaatataaagagcatacagcacctactattcaataatgaggcagaagtcaagttgaaaagttcagttctgaagatgtcattcataatgataccaactcagattgtagttattttcaagtctaaacacttaaacatttattagagtaaataaccgttaaaaataagaggagaaaaattatcttctttcaagaacctgcctccaaatttatcttaacctctgaaatgcggccttcgtagtttcagctaaggccttgtttcatcagcatactgggtcataagttgaagaagaaaaaaactggagtaaaaaacttgaggtttcagatagtctcccccaccctctgggaattcactggtgactgatttaaatactgaaacttcacatgctactttgatgactatatattcagtcaccttcctttggattaaattgccatactcttattttttcaatctggttttctttgcaatgtttgaccctgtcacccaattacctcatttttggtggggtaaaggtgagaaaagatcaaatcactgttagtagctgcagaggctttaaaagactcatttaccagtatggttgtatcatgtttaaatttctaaatggctaagcaacatgtgccactctctgagtagacttaaaatgatgaaactaagtgaaaccatattaactacgtaaggggatcactaggatcccaggttgtgctatttgctagcaatcattacagtttatttaaactccgtgtgctagaaagttataaaatggcacaaggcatgatcccgatttgtagttcagagactaaatctatgagatttcactataggtaatctaactggtatttgtttaagttacagatacaatcagagcagcccttctcaaactttaatgtttatacagatcctctatacatctttttaacatgcagattctgattcagtgggcctgagattctgcatttgtaacaagctctcaggagatgcccctgttgctagaccatggaccacactttgagtaacaaggggttagaagcaaattatcaactgggagtacataaataattcactaggaagctcattaaacacagatttccaatgctactcccagagactgatttagcaggtttagggtggggccccaagatttcgaattcccaaccacctcccaggtgctgctgctgctgctgatctgcaaaccataatttgggtagctttaatttagaagtactcaaactccctgcatctcggacataaagcaaaagttaattatggtgagatgaaacatgggttagtggaaagtctcttaggttgtctagaaggaaactgggttctttgacacagagcttctctacagatctcagtttcctcacctgtaaaataagccaaatgatgagtgcccccctccccagatatctaacataccaagcagatgaatacacttttaatttgacacataagttttaactattttggccatgtctcctctaacattcgcaggacccaggacaagagtacaaatggacacctaatgccatatggataaacatttagtagttatacattaagccaacaagtacatgagacaatgatacaaattgcttattattgcaataggtgacttagccaatacgtgcaactgtcacacattcaactctaattcatgaatactgcccaagaccacagtttgttacatgaaagaaattgagatggatagttgtttctcctaggaaacaacactttattatttgagaatcttttgcacttaaggtattttagagaaaggatttgacaggttaattaattatttttccccttacctaagcacttctattgctaagtcctccctccactctgaaagggtgtccatctctgatgtctgcatttgcacaatccacaaccctttgtgacattcaaatgcagtctccttttattctgagatacaggaaaagagatgtaagcacctccctggggtctgaacagtgttaatgatgagatcagatgtttaggattatacatcacattctgccagagctgaacactgaatcccagtgaccaaagtaaattggcatgtgtataaaatacaggacccacggaaggggcacctatttattggatctagggcagtattattttggtggtcataagggaactgatacctgaacctgaatatcactcaaagatcactcatggtgcctgatatttggaagagacatttgaaggaccagacgaaccacttattcttttagatgctctaaaattgaaccgtataaaaagtagactatgccgaagtcatatcattttagctacatggagaaatcttgttccaaatcaagagataatgatataccctctggttctttgatgacagtgtggtggctatatgcagaatgtttctgcaccatttgcataactactgcttaagatatccactatgtcattcaatatcccttatatgagagttcaatgaggtagacgtccttaaatttactatcaggttaagaaaagagcagattgtctctttggacaacttcgtgtatttctttctttagctgcctggaagctcaacactaaatttagtattcatctgcaatacttgactcagcccatggtttttacacattaatatttcttttctctaaatgccttgttggaattgtacttttaagttcatctattttttaaaatgatttaaaataatcacattaacccaggaagaagcagcatataaaagaaaggaaagaaacaaactgtttaatgacctatcttgctgggttcctacaactcaagtgggaaaatatgtgcatggtagaattatgcaaattactgtgtaaaacttcctataatttgaaaggtattatgatattttatctacctcatgacccaagatggctgctggagttccagccatcatcaggttagagtatgtcagtgtagacagaaagaaaaaggaaagtcagaagagcaaaatgaaatcattttgatgtttttagcttttccagaagctctatgagacacttggtcacatgaccacatctactggcatggactactgaaaaatgtaacattttattcctggcaacagtgaacttagctaaatattaagtttctgttactttgaagaaagaagaaaaaatagatatagaaaatttcaatccctgccacaattctttgttcatattgggatgggaacttgttaattttttgttgtagaaatcacacatttggtttttcaaattgtcataaagttttaaaatatctgatgccacattggatagatttttattcaaatattttccacattttagacattcaaatcttacatcgcaaattagtataatttttaacaacaaagtaaatgagacggacaagacaagagacagataacttccagaattgttcatgtacaatttggctttgtttggggattgaatcaatggtttattttcataaatattgatttcttttcctggttgttttatgaaccgagtgggaagggccattgtattcagtctttgttttgttttcatttagtcacagagtgcagcagtgattgtggataattccttgactatttgtactttagattcacatcagatgataaattgagcatgagaaatatgttattaaattgactgcattgtaaattggcactttacattttttatttataaacatggtaccttttactcaatatccaggaaactttggataaatatgaatttccattaacttatgtgttaactgccaaaagctattatttatatctgaaatgaactaaactaagataatttaatcttctagtccaaggtcaagtgcattacaataaaacatgtttcatgaataaacatcattaaaaacacacagccattacatagcagtttttcataacacaaaaatctgcaaattgagtaagcaaaatctccactcactgaacttttaaaaatcctatgttaaattaataatctcacttcttctaagattatatactttattttttacacacagatagtaatgaatagatattcattgattctgatgtaggtggtgtataagtgactacgtttgtgtgtatgtgagtgtgaatggtataaaatattgtgctttgggaaagtcaaaattgggaatggatttaatgtctgtgtatcaatcaaccatgatatcaatgatgcacttataactcccttccccaataataggttttactttattaatcataattttttggtgggggtcactattagaaatttccattgtccaattttctcaccatgaccagccaagcatctatcacttgtttttaacttctcaactagttttcacaatttgttgtcctgtaaagtaataaatggcccaaattttccacacgctaattaaaattccatttctcatgaattctttaatcgagtgcaagtcattatgtgctttgttgatatcttaagtgcaaagataattgcaatgggcagcgtgaaaagggtttgattattgcctgtcgacgcttgtgaattctaataggtctaattgcatagcatcaattcatcatctcagcatcacttctttttattattagctctctgaattgtaatgtgctcataaagaagtgttgtagtatatcagagatgacatggtacctggcctattataattttcagcccttaccttgtgcaactcttgaaattaaaagtttattatggagtgccctttttctgaaactaattttaaaatgctcctgtatgatgaaatgaatactgtccaataatctacatattaatttgcctttgtaataattccattaaatgactgccaagacctttttcgctcagattgtgcctataaattcagaacataatgcattagttggaaaacatttgttaggctttttaatgggaattcctggtagcatttctcagagaatttctatactagagtgactatcctaaggctaaagaaagaaaaagattccactgcataatgatgtagaatcttccacgcaccccaataatatgactaaaggaccaccagcaattgagttgccaaacaccctatcatttgcatgtagggaatagaacagccctagtgtagagaaggaaagtaaacctttaattactctacagataaaataatgttctatatatgtgaggaagtgtgtctaataataatagacacaaatggggacttacaccctgtgtcaaacactgtactttaatcgttatctcaaataatctcagggattcttatgaataaagtttcagtgtgataattttacaggcaagtctcaaaatatcaccgaagatcaccagatggtatgtggcaaagctggaatttaaacatctagacagaagactcccatagcttgtctgctattttcaacacacactatggcatgactcagtcaaattaatgccatcagaatcagtaacagtgaactttggaagaaggatgatcatactgttaaagtgtgagtccaagtaaacccaaaaactaaatcacacttcaggggcttctatttttttttttaggataatatggtcagaagtaattataatccatgttaaggaatgagtcaagttcctagaaggagcatccatacagcaaatattccaagagatcaaggcaaaaccggtgaggcttatcaccttctgttggaagtctgacaacagccaacttagctaaatactaagtttctgttacttcaaagaaagaagagaaaatagatacaggtctgttggaagtctggcaacagccaacttagctaaatactaagtttctgttacttcaaagaaagaagagaaaatagatagaggtagagaatttaaatccctgccacaaattctttgttggtgttgggatggaaacttgttaattttttgctatagtaacaatatatttgattttacagaatcacttcaagatattttattggttttaagtattgggaagggatttatactccagcttttgttaaaggagtggcaaggccacattgccaaaaagcaaatgagctgagacatattgttttgggcatctctgggtaatacagcctgccacagggaatgagtcaacttggtgttactgcttgttgggcagtaaagcaatttgcaaggaagcagtcccccagcaggtataaattattgtttcaaacatctctctgaaaattactgtaatgagaaggtacccctttgccttgtgtgtgtgtgtgtgatgacaagcaaaagtaaaacttaattcattttctacagatcaaatgtttggttcttttttaaaaaaactttcaaactacgtggtttaggtataaatattttattgaatatattggttcatttccaaatataaaaaaaatcaagaagcaaatatggattctaaatttgctgtaccataagtaatttgcaatgaaacctacatctgaatagagaaataaattaccactcaaaaatttccattacttatgttctactttgaaaatcataggttggaacttacatggagctattgcttattctgtttaaaaagtatatagtcattctggttttaagaatttgagtaaaatttacagaataaaatgcaaaaatcttaaatataccatctggagttttgattacgtacatacatcaatcaatgtggagaatatttccatcacatcagaaagcattttatattaagtaatttttattgttctattttccctcatggccaatccagtgaatctttacctctcaaaggcactgctctgacctctatcaccatgaattatttttttcttttcttaatgtaaatggaaccatacacaatgtactctttgtgtctattttgttcagcatgaagtctttcatattatctatgttttttttttttttttttttttttttgagacggagtctcgctctgtcgcccaggccggactgcggactgcagtggcgcaatctcggctcactgcaagctccacctcccgggttcacgccattctcctgcctcagcctcccgagtagctgggactacaggcgcccgccaccgcgcccggctaattttttgtatttttagtagagacggggtttcaccttgttagccaggatggcctcgatctcctgacctcatgatccacccgcctcggcctcccaaagtgctgggattacaggcgtgagccaccgcgcccggcccatattatctatgttgtcacatgtatcaatgttcattattcttcattggtcagtagtatttcattgtatgaagcacaattagttcttccattctcccatatttttgctttttctgctattttttctagtttcctgatgcctcaaaattatttccttcatcacaccctctctgtttcaagaactttagccattcttgtagggtaggtctggtctgctcatgacaaattattttagttttcctttgtctgagaatgtcttcatttcccccttcattcctgaaggataagtttgctggatataggattctgggtttgacagagttttaattttatcatttgaaacatattttgccacttctttctggcccccattacttcttttgtttgtttgtttgtttctggtttttttttttttttttttttcagagatggagtctctgctctgttggccaggctgcagtgcagtggcatgatctcagcttactgcaacctctgcctcccaggttcaagtgactctcctgactcagcctcccgagtagctgggactacaggtgtgtgccaccacgcctggctaatttttgtattttcagtagagacggggtttcaccgtgttagccaggatggtctcaaactcctgacctcgtgatctgcccacctcggcctgccaaagtggtgggattacaggtgtgagccacatcacctgacccctctggcccccattacttctgatgaggaatccactgtaatttaaatggtttttctccaatatagataaggattcatttctgttttgctgcattcaagattttttctttgtttttagttttcagatgtttatattttgtcttagcatgaattcctttttgttgtattcagttaagttcactaaactttttgaatctataggttatatcattggccaaatgtgggaaatttgcagtcattatttctttgaatactattttagccccactttctttctgttcttctgagatttcagtgatatgattttagatcttttgtaatagtttcacaggtccctgaaactctattttttttgacgtttgtttagcctattttctattttctccttgttttccactttaaataatttctattgtcctgtcttcaagttcactgattcttccctctgtcctctccattatgctattgagtccagccactgagttttttatttcagttattgtattttttggttctaaaattttcatttggttcttctttacatcttctcttctttgctgagactttctatctgtttgtttgtttcaagcatgtacataactgtttattggagcatttttaaaaatgatggttcctttaaaatcttagttttaacacctgtgtcatctctttgttgggtctgttgattgcctattctaattcaagttgagattttcctggttcttggtataatgagtgattttatataataccctgtatgttataagactctggatctttttaaaatcttgacttagcagactttctctgaaactgtatcacactcacagggaaaggggattctgcctcattacaactgccatgttgtaggggtgaaggtccagttcctctttcggcttcctttgacactccagggaggcaggggtgttttctttctgctgagaagagttgggatttcagaccctgctgggcttcagctagtgccaccttggctgggaggggaaacattgtcttgttactactccccagttagcttccactgacccagtagtgaggaggcctgctgggtggtagtaaaagtgccagcttcctatgtggtctgctctgacattatatggggaggggggttgttaccaccagcaagggctgaaattggcttcctaaccagcctcctctgataccactcaggacaggaagtgcctcggtacagtgaggtgcaggtagaaatctcagctccccactggacctttgatgacaggggaagggatgaagccttggctttgtctgtgctgtatggttggaataggatagtttttatctttctgttttgttaggtcatccctttcctgtggtggtggtggtggtggtggtggtggtatttatttatttatttatttatttatttattttttagtctgctcttgttagcatttctgggttgctggcttctttgggacccaggctgaaatctgttaggcaaaaagaaaacccagaaaactcatcaccgtgttggtcctatgggctgccttcttctgttcacctttcagagtcttcttatatttgttttatgtatactgtccagggtttttagttatagttagcaggaggaatagggagaagtccatctgttcaatcctagtccagagctagatattttttgcttttctgtgagtattttaaatactaggtcttggtgagtgctaaagttaggaaaagatgaaaataaccttaggcttagaacagtgcttgccacatgttaagcactcagtgaggatcatcttattctctttgtacaatcctagtgtctctgaaattctaatcttcttttgtaggacaggttacgcccaggtttggaagaggggtgcaaagggagacatatccaaaatcctcacctcactagtggatgcagaaaccttcccagcatttcttaatacacatcacagaggtagctgttcctggcctgttcatgcttgtggctgacagtacatgcatatgtataaacacacataaaacctccaacttttacatattgatgaagacaaacaaacctaaggccaagacatacagactctgaaaatctttccagaaggacataggaagggatctacttcagttcctaagaggatggtaacttttgcctatgaatgtttgacctaatgttttctaatgccaggatggttctccatagagtttatttgtaaaataaaacattgtgctttctatggagactctttgtaattctattcctaaagaaatccctgtgatcagctaacataaccacatctgagggcttcagatcttctgatggacttgtgtcttttccaagcatcactgtagttcatctctctctcactatttatgaactccacgtacattttcactgctgtcaattgactagtttgcactgaaatatccaagcaagctttgtgaaaaaatggaagtggctctcagtccttagatttgtaggcagttgtgtatggcacatagttttctttactatatgttctttccagttattggtaagaaaggcagtcacagaggatttgtccagtgggactccagtggcaaaggtttatctgactctttccagtagcactaaaaacacccctggacagatttcatggagttaacagactctgttttcctggtcttatttagaagtattgccttccgtgttttgcatattctgggcacagtcaatatcaaataattaaccatttcatctgttcaagcagccatccaccatctactaactgtcatgctcctgaatttacaggcacgtccagcaccgtttcttttattcttttcttctgtttttttttttttttttggtttattttgtttagcttttgttatggtttagacttgtgtctctgcccaaattttatatcgaattgtaatccccagtgttagaggaagggcctggtgagagctgtttagatcatgggggcagatttcccccttgctcttcctgtgatagtgagttctcatgagatcgttgtttaaaagtgtgtagcacctccatactctctctcttttctcctgctccagccatgtaagatgtacctgcttccccttagccttccactatgattataagtttctggagccctccaagccatgctgcctgtacagcctgtgaagccatgagccaattaaaccacttttctttataagttacccagtctcaggtatttctttatagcagtacgagaatggactaatacagcttttttcaaacgtacaattcagtggtgttggcacattcacagagttgtacaactgtcaacaccactatctaattccagaatatttttgttgccttaaaaaagattctatacccattagtagtcagtgttcattcccccttccccactccttgacaaccattaatctacattctgcctctgtggatttgcctattctggacatcttatataaatggaattatatactatattctcttttgtctctgttttccttaacttagcataagatttccatggttcactcatattgtagcatttatcagtactgctttcctttttatggctaaataatattccattagatggatatacatttggttattcattcatcagttgatggacattgagttgtttccattttgagctattataaataacgcagctgatgtggtttagatctttgtcccctccagatctcatattgaaatgtaatccccaatgttggaggtgtggcctggtgggaggtgttttggtcatgcaggtggatcctttataaatggcttggtgccgtcctcacagtaatgagtgagttatcactctatgagtccacgtgagagctggttgtttaaaagatgctggaatttcttcctcactctcttgctctgtctctcgtctcttaccatgtggcatactagctcccctttgccttccaccatgatcgtaagcgtcctgagtccctcaccagaagcagatgctggtgtcgtgcttcctgtacagcctgcagaactgggaaccaaaataaacctcttttctttttaaattacccagcctcaggtgttcctttatagcaatgcagatggactcataaaacagctatgaatatttgcatataagtttttgtgtggacatgtgttgtcagttctcttgggtagatcctagcagtggaattgttgagtgatatggtaactctgtgtttaacattttgaggaactaactgttttccaaagtggcatttccattcctatcactgatgtatgagggttttaatttctccacatactaacacttattaatatctgcctttttgttgatagccttcctaatgagtgtgaaatgtcatctcattgtagttttgatttgcatttccggaagaactaaggatattgagcactatttcatgtacttattggccatttgtgtatcttctttacaaccatttctcaaacccttctttgactcctccttaaatctattaaaagacaaattacatgcttagcttttttccttcattttggcctgttcactttttggcttattttagaagtatgctttctttaaacttcctttcttctcacaattagtgcacatgcacaccctgatctttttataatttaaattatttcaactaatgtctcaattaatgtcatcaatgctctgttgacatttaatccagaatgagctcttcctactgcaaaatgagctctttttttggcgctttgttataatttatgagaactaaagtagagagtagacaagttttacttttggacaagttttgcttccacatggaaggatttaaaatgatagcttgtcattagtgtgtgcgacaacagggcaaggcaagccaggagaggcaacacaggtcaaggtcattaacacaatataatgaatgaaagatcatagctgtgggtgcagttggtgtgagtctggtggacaaaaacaaggtcagagtcttgggtgccaagctgacactcaaatatcagtgatgggtaaaattttggtaagagagctgtacactgccatatagtacaactctacatttgacattttgagtctagtctagactggtagttttcaacctgtggttcctaggccagcagcatcagcagcatctgggaacttgttaaaaatgcaaatcctttttctccacccctactccattccagacctactactgaaatagaaatactgagagtgtgacctagaaactcatgttttgttttaccagaacctttagatggttttgatcgccctcaagtttgaaaactactgaccaagacttttaaggaggtgcaaaaagaaaaggtggttggagatgtcgccagagtttaggattaagtgagaacacacaacaacaagggtatggctgtagccaaaagcaagttaagcatagcccatgctacactgctaccatggaattaggcaacattcacttagccagaatttacttagtgactggttgttggaataggagagtgggccctagaatgaaggagacctgattattctggtgcagggaggttcaaggagagcaacccacgtccttacttgtcttcaatttgttatccctagtgtatcaggcattctgcttgttaaagggatctgttatattttcttctttggacttaaattactcagtataaataatcagcctcattctgcatgcattaatgaactccattagaaggagggaccattttttttttcctatgttggttaaggaggcctcttagcaaaatctaaagggaggtcttctccccaaagaattgtttttgtaggccttttccagtcaagaactgtgacagagattgagtttatgctgggtgcagggaaacatggagtaagtcacgtccataaaggtgaaggaaggccaatgttttggcatgggtaagttgctaagtacagtgtgggtgcatctggctctcacccttattccttgagtgaagtcattcatccaagttggcaagagcaggtcataggaaaaatgaggacatctggaagagtaaatggtttgtgagaggggccatctctcagataggcccataggctttctctggaaggatgtcagaaagccacatttatcagaagctgcaaacacagccagccatgtcctaggaaggacagtgctctttctatcacaagagaattccaagggcaattttctgttttctttttttttttattttttgtttttttgtggagacacggtctccataaaagaaaccagattggtcttaaattcctggcctcaactgatccttctgccttgtcctcccaaagttccgggattacaggtgtgagccatggctcccacccccttcttttctgacagtaggaaaaataaaaacacttttatttcatttccagcttctgtgctttctccagctctttttcctatctgaagaagtacacaaaaaatatctatgtgacaaagctcccaagccaggatccagtatgactttatttttctctggctgtgtccaggatcatggtgacttgacccatttagaggaatgccaccatatgctgctagcaactgctgaggtttggcatttcacaggtttctcagaacctaagaactaagtgaggactccaagaatattccatggactctaagtccatggctagattcccaggcccagaggatacatttggaaaaggaccaaagttgtcgtcatgaaattctatacattgcaagcctgtaatcccagcactttgggaggccgagatgggaggatcgcttgaggccagaacttcaagaccagcatggtcatcatagcaagattccatctctaaaaaaacaaaacaaaatgaaacaaaacaaattatataaaaagaacattaaaatgcaagaaataacaaaacatatttgatttaatcttgtgaaaactttcatattttcctaccaataaaattgtctatgacaattcctttagaatggttaatttggttgtttaggatttttattgtatagcagtgtcaaacacattcttgccattcacttattctgttaaagagaactattgacactctcctaactgttgctccttcaggaggagataagcagtaagactgttaaaattctatcaaaatactctattgatatcatgtgctgcggcttcaaaacactactcagtaaggatgctttggaaagtaactcagctgcctaatgtgtttctgctttaaaatatctctgggcagctaagtttgtaacaaggcatataaatctaatgtttagggtaaaaataaatatcccttttggtccaagcagtttaaatagtacttgtaattaatgcataataattaggtatctaaaaacaactcttcaaaactgaactatagttttctggcaaatgtgtaaatccatgtttatttaaagtgtattatatttataaaagatgaggtataaaataaatcgggcttaaaacaatgctgtcatcaattctaaatgaagcactatgaaacagctagttcaaagtcatgaaaatattgaatattttttttctcctttttctcctgtattttgtgtgtgtgtgtgtgtgtgtgtgtgtgtgtgtgtgtgtgtgtgtattttcaaccaggaagcatatgcttttttatcatgttgggaaaataaaatcctaccttttaaccttaaaaaaactatgaagatcttagcaatttctacaattcagttgtttgttaggtgaggaatacattccttgttaaaatatctatttgcataatttggtgagcaattacattactagtgttcttttcttatttgagatactctcccaaggaattgattatttgcattacaaataaaaccctgatgaaaatacataaaatacataaaatttgtataaaactatatatttatataagttatcagaaaaaagtgtgaaggcatatgttaagtgaattaaaatccactaagggcttgttattaccaagtcttgacctaggcaacaaacatatttatatccagtcaaaaggttggtagagaaaataattacatatgacaaaagtagaagttataaaaatgatgttccagtaagaagagaaagaacaaccagagaataaaaattcttggaaataagaacaaaagtttcagaatgaaagaatgcatgatggaaaggaaacagctgaagacttactgtaccagaagaataagtcaaggaaatactctataatgtacagcagataaaatatttgagagaaaatcaaaggaaatgagatttactcctagacatataaactcgcctattaagagttctagaaagaatggagaaaatgaaagagtagtaataattttataactagaaggagaaaaatgtcctgtcctgaataaggcatggtgaaagttcaaaatcccaagtataaaaaacagttagaaagaatgaataagacctactatttgataatagtacaaaggaactatagtcaataataatttaattgtacattttaatataactaaaaagtataattggattgtttataacacaaagggtaaatgcttgaggggatggataccccattattcatgatgtgattattacatattacatgcctgtatcaaaatattttatgtaccccagaaatatatacacctactatgtacccacaaaattaaaaattaaaaaatttaaaaactgagaaaagaatttcaaggataaataggaagttgataaaacttctggaaaggagaaaaaataaaaataaaaaacagcttacttatggaggtataaaaataaaactgtctttttctcacagtagacgtgaatgaagaaaaatcttcaacattcggagagaaaaaataatttttaaaaattagaaattgagtatcttacataacaaaagaaatgagtagtattacggaagtctccaatttcttcccttttcatgtttttaaacccactctatattgcactttgtcctcaggcttcgaccctcacgacggtaagctgactgtgacagcgacaaactttcacactgagaagtcaaaggcagaaatgatggggattattttcctcactcatcttattttgagagtaagcgcttttctcagaagacgcccgtgaaactgctcctcacattctctgcccatttgcttctcaccacagtctatcctttttctttgcttcatttttctccttagcacttgtcactgtttgacacactatgtattttacatctttcttgagaaaaattaattttgaacctggaagcatatatgtcagaaagacagcattcagaattgagaacaaattaaaaacatttggaaatgcagtggcttaggaaatttccagccacagaccatctctgaaagaattactcaagaatatacaccacccgcaacaacaaaaaatgagtttaagagtgagaagaccaggcatccaagaagtagtagaagcaaagaaaccagtaatatgtcagttctgacataattggttaatatgtataatcatgaactttgagagtataatgatgaaatattgactaaatagagaagaatgtattcctatcccatgtatgcacgtggtaaatgcaactacgtagaagtactagtgataagtagtacttctcatcacctcccacatgccaggtactcgacttgatgctttcacatataatacataatttattccccacacaacaaacttgacaagcagatattatcctattttttagagaggaagaaaagtaatttgccccagttcacacagtgagtgagtggagtgtgctgttgggttatggagacttgtttttcttgctctctcctgatatcatgctgtctgataataattacacattctattgatcttttttttctgatattgtcagctactgctgtgtaacatattttcctactcataccaaatcttcccatttttactgccgctaatttctttcattatagtgcctctcaagccattttctcatatcatctcaaccacaaccccatttctaaataaagaacgaaaattgttattaattgacctgcatgacaacagtatattatcagggagccagtcaccagatattatttattttcaggtttttttttctttttaaacctgatactcatcaaagcctgcatgcaaacatttcattcttggcatctgaattactgtggaaaggtctcttggttttcttcgagtgcttttacattaatggtttctactaaataatctcgcagaggcacatgttgacctctgtgctcttagtctcgtaatgaattatgttggaaaggctcagtgatatattctcttcccctcactgattctatgtcaggcccaaaataggcaaagaaagggaaaagttaaaaaagaaaacctgtcttgatactgaacaaaatgagttattttttattgtccttttttcttttactcttaactaacacttctcttattcttgtcccctttctgcatcttatttctatgttgaggataggctctcagaagacctgacaagcactgcagtaactcacaccccaattctatttccattctatttccctatttctgttactaactcagtcacttagagtcaagctccttgaaatcaatttttacactttgttttctcttttcccatccactctaaaaccatcatcacagtttgccagttcaactctaagattcttgaacggtctgcctctctttttcacgccttggactctgctttcatgtcagctgatctcttcccttttgtagcctccaattcattctgcaaaggagtaagcatgaggaagtaaaactactgtcatgattttgcatgggaattcatgttcccaaagaatatctcttggctttactccatgatgtcttatagaattcttgtttaaaaagctgctcccacccttctcttctccatgtgaatcagtgtatctgatagcagtcatgttggacttttttccttgagtctttgcaaactctttaagaagtgcttttccattctcaagaggatggtgagtggaaataccccgattatctcaaagaagaggaaaaagcaattactccggattttgaagattgagcagaaaacaattgcatttagttaaaattactcttaaaaatcccagcactttgggaggtcgaggtgggtggatcatgaggtcaggagatcaacaccatcctggctaacatggtgaaacacttgtctctactaaaaatacaaaaaattagccaggcgtggcggcgtgtgcctgtagtcccagctactcaggaggctgaggcaggagaatggcatgaacccgggaggcggagcttgcagtgatccgagatagcgccactgcactccagcctgggcgacagagcgagactccgtctcaaaaaaaaaaaatcccttaacctacataaaagtgaaattggtgacataccagttcaaaataagttcaatacaaatgattctccctatggagtcgaaagacatcactgtttcttcaaacttgaggacagataaaatagttaatgatgttgcattggaaaagtaaatattatttattagatctgcacagtgagaagctataatgtagcagttctgaaagtgtcaccagaaagtttgaaaatagctctagtgcacagtaaacccattatctctgaaaagtaggtgaggatattgactgatctactgggcccagcaatgtaagccaccctgctcctactcctgctgtaacactcactcatttaaataaatttaaataaattgcccttattatttaaatattttatcattctcagtccaccaacactttgttcatattgttgaatttaaatgagttgaacttgtaaaataatgtaacttcacagtatagaaattttcacatattcttttggctagaagttatgttaatgtaattcttgaagtagcctcttctcatttgtcttttctaaatacaacagttccttaagaaaatgagatgtagggcctggagtgaagacgtagagcctaggtttagtgcagagctgtcctatgaatggatcaatttcagagagaaatcagatccgctttattttggtggagaggtggattcattatatctaaatgctactttttaaagaaatgtgaatagtgagcccattaattccttcagagggtgtctagaaagtctgtcatgttccattttgtgatttgagagccaaaacctatctctaaaacaaagcagatttattctaaaatgagcaatatgcagatgagggaaatgacaggtttagagaatgcacttatttaatcatctcctgaaaaaaaaaaaaaaaaggcaaagggatcactgcacattttttttttttttctgtttgagtctttggatagaatctcatagcttttgttaaagagtgtgatagtgttagaatcttatttttaaatcttccatagtgcagtcattaggagatttttgatgaggttttgatgagtctttctatgaagaaacagcttttcagctctataaaatgtatgctgaatgagctgaaccagtataactagatgccattgcttgcccagtctagattatcccttctacctcattgttttctctaatctggtacatcattcctgattagattgattatatcgggccaacttttatttaatcacccacagattcactaattatccattaagcaactgttcccatagaattcttggctttgtgggaaacacagacatagatttgtcatattccctgcagtggaagcatcgagtcactgcaggaaaacagaaatcacagaatcatgacattgcagagttagcaagaatcttgggacataggtagtcatatcggattgccttgaatgatagggcattccctgctgcctaaggcaggatgccatatgattggagagctctgaccgatggaaacttctcagaaatgttcgtgttcaaagtcatattaatggtttatcgtaagtgatattatagagcaacagaggtgaagtgaattcaaactctgttcatatagaggaatttatggatctcatctttaaggaagcgaaattcttcacagtgtaggaatctccatgagaaactatttcataagaagaattttcagagaaaaaaatggggggggctctccagaaatggggaaagtcctgtagtcagaaaagcacagacctgtttggtgagagtcatggaacaattgccctatgcactggcacatagtgggttctcactaaatatgtattatataaaggacagaattaatgactgagtggatgattgcagaagagtctttcttgtccaggcgtgtggtggcacgggagtggtaaaggaatgctgacgacaagcacatgcaacctcagcatcagcctgcgtgtcccgacattgacccatctgcacatttcagtcccagcctagattctgcatttgtagaattacccttgcagtggggactaatattcattcattttacccacagtatagagtctttaaagccgattttctcctcacatcttaataaaatactggttttgcatctctctgaaaaggctgcaagttgctgacatctcttgaaccagaacaaagatcttattatcatcttccttgaaacagtcatattgtctatttggaccttcacctcctctcacccctgctattgaagcactagaaatgccatgcatttgactcacttccttctgggatgtgttctctttgggttcattctaaaatgacatgaaatgttggaattctgcagataattcagcttcccacatttcctctgagacccctctctgttggaaataacactattgtgatgcagatgcccccaataccctgtggaatctcaaaactatcaatggctgaccacaggatatcccttttccatgagtttcaatctgtgttattaaaaagggacccttacatgtaggagtccaatttgaaacaggatacagtcccatcaacaaggtcagtctcaaatagatttgtgcaggaaagggagagctgataaaaaattaaacatgagctttgcctctttcttttttaatatagaggatggcattttggtagaaattgattgaatgatattttataacgtgggcttaaaacatcacagctttgaagtcaatgaagaataaaacatattatcagcacatgatgccccaaacataataacattatcacattctcatgtaaaaatggaaccaactttccagttgagctgaaagtatgcatttgagctttggcagtgcattctgtatgcctctatcaactgtaaaatgcaaatgtttagttgctgtgtatgtaaccttagacatagatatcttatttagagaaccatagcatcaaggagggtgagagaggtaaaccaaaagccctttgtaaccaagaacagtgaaaaacagcaatgggtcaactcacaaactcaaaggaaactagatttaaaaataacattgtgaattctagtttatcccaaactcatgcaaaaagttgaatgactatagtctttccggacatagacagaaatccttcatacagctgaagaaatgtatgagagtaatccgaatttagaaaaatgctgcagggtgtgttgaagtacattttcaatgatatcttcggcagattgaaaaggaacatcttatagacaattgattgtttcttgaaatataataaaaacaaacttcgaaatgtgtatatgaaaacactgacctatgtggaaagaagaggcagcatttactttgtaatgctatcaggtggtaattcaattttctgttaactgaacttcaagtattctgtttcaggtcatagattggtggtgcttatataaattggccagtaagatttacaaatagtacctttagtgctcagttttgtggttgtatctctaaaaaagaaaatcagtttaattccatgcattggttttcttcttaaaattcatgcaatttgatatgattgacaaggcacagcattattatgcagtctgttagaaggaccgattatgcttatgaatacaagaatggagtgaatgaaagcaatgtgtaattgattctacacttggtctgactgttcattaacagtttgaatgtagcgcagttgcttctcaaatggaaaatgatgagagcaacctatctgtgctctctcatttgttttaaaattcattatgctaatattttttcacagaatgtttttgctgcatttgttttgccaaggataagtctgattgaatctttgtaaataattctactgctttcaatatttatttggcatttcaatcacatatttttcaatttacacttttggaaatgaaagtaggctctcccccacacctctttcaaagaaaaccttatatcctatcctccttttctctataattcagactaatttcccaggataaataggagtgggggagtgcaaagtggtgcgatagttatctcttcagaacaaagaagctgatttacagactgattgatttcagaaatagatgagcaaaaacagattccatttgtcttgccacactttagtctgatgaagcacaaaagggcctgccatctcattttccatagctcttcaagaggttgcatttgaaatgctgattaaatgtacaaatcgcattgctgttttcgtggctttcctgagtgctgtaggagagggcttcagtgcacaaaggctgcttttcctttcttgaatgtggagctggacactttagggaaataacatcactttcaccactcataggaagttatgatgctaattctgtgacagccatgtctgccctttcctctgtccacaggttcctgccacattataaaacaaaagaactaaaccagcactgtgccagtcatttctatctaggggctacaattacattcattattcccaaattagattgtgtttacaattaatactaatctcatgtttcaatctttggctacctcagatttttattaaattagcagttgactgattgagataataggtctgagaactccatactggtaaagttttaatcatctcagccttttctctgatttcttatttatctgccacctgactttgtacttggggctcaccaaaataaagcgccaactgtctggggagtcctgcattatagctgttttaagatatgttcaaaatttttttactgctcttcccatcaagaggtgaggtctaggtccttccatctgaaaaaatatgagatctttgtgacattggcaaccagtagaatattgtggtagtgatgctgtgtgactcccaagcctgtgttataaaaggcaacatggcgtccacctgctggtacacttgctcttagagccctgagttgtcatttaagttatccaactgctctgaggctgctgtgcagtgaggaaacccaaactagcccacatggagagtccttgagaccacatgaagagagaaagatgtcagtccagcctttggctcccacagtcctccactgctccagtgccagccaccagttgactacaaccaaatgagagaccctaagccaaaccccctagccaagccattgcagaaggtctgacccatagaagccaaaagaaataataggatggtggttgctgtgttaaaccaccacgttttgtggtaatttgttgcatattgcaacaaatctaaccacaaagctaaccagaatttgcatgtatacaagcatgaggctaaagtaatgagattcatgacaaacatgccaaaatgtatacatacaaatgtatgccattcatttctttccataaggagtcaccttgagaggaacttactcataatcatattgtcactgtgatgttgtcattgtgatgctgtcattatctccccacattgatctctgactttgggcacattattctgtctctctgggttgcttgaaaagtaggcgtagattaaatttttacatagtcttttcttaatctctaaaaattcttgacaattattcaaaattctttggttgttgaggtaaccaaaggaggagataaccaaaggaggagcataagaagtatgctctggccgggtgtggtggctcacgcctttagtcccaacactttgggagaccaaggtgggtggatcacttgaggtcagcctggccaacatggtaagttcgagaccagcctggccaacatggtaaaaccctgtgtctactaaaaatacaaatattagcttggtgtgatggtgcatgcctgtaatcccagctactgaagaggctgaggcaggagaattgcttgaatccaggaagcagaggttgcagtgagccaagattgcaccactgcactgcagcctgggcaacagagcgagactttgtcttaaaaaaaaaaaaaaaaaaaagtatgctcctatcctacgttaccactttaatatgtaaactgatgtcacactcagtgtacatattaaaattatagtaaaactttaatggttgatgctggccatgtaggaaaaaaatgccctcttgttcatcatttaaaccctatatttatctgaaaataattttttaatataaagaaattattgaggctaggaaaataaaagaaagatatacctaggggagtcattctgttaaattccttgaaattatatctatctttttctttaagagtatttttatatgtgtaatgatataagctcatctttggaaagcacattaatgatctttacattttataaggacagggtaaatgggattccagaatatggattaataaatcatatactctttgtttaaatgttttatttaatttttgaatagctaatgtattcacataacttgaacatcaaaaaataaaagcagtgaaaagtttcctccccatattccctcccccatcttcatagtttctgtcactcttctagtaggtaaccactcttattaactgctagtttatccttccagagatgttttatgcatgtagctaaaacaaacctatattcttccctacatcggtagaggaattttttttaacactaatgttagtgtgcttttctgaattttatttttatgttgtaatgtgtcttgggtatctttccatatgcatacatgaaggccttctttgtctattttacagaagcctagcatttcatagtataaatgaaccatcgttttactaacattgtttagtctgtcccctatggttggacatttagctgtttcccatcttgccttattatatacaatgtttcagggaatgacctgtgtaaatactgttctgcatatgggcgagcatattatctttaggatatattcctaggaatagaactgctggatcaaaaggagtctacatttgtaattttgttagatatgattaaatcattttctctggagatagtgccaatttgcacttcgctgtataatcgtgtttgggaaacgtgaaccatgattgatgctcatttatctggacaaaaatgaattaaacttcttagaatctttagctcagttcctgatagacgtgtacagaaggagatgcacttgagagctgcaaaaaaaaatgttattctgatttattccttcttttgactttgaatactgaaggccaaagaggagagtgacttgcagaaggtcacgtagctgattagtgacagatctgggacttacaacctgtagtcagatcttaggattggtgttctttccacatgagtaaagagatggtaactttctgtcattcctgcctgtgtgctgaggactccttgtacactgctgctgttgatgatgacatttaccatttcttgagccttcctatgtatcagactttgaatttaatacttctatttacattatcttatttataccaagggattcaaaacccatgtgcaagataaagcattgtccatagactttgcatccatgtatattacatatatatgtccactatgaagatgctacagtgtttaataaaacataaatcaatacaaatcatcattaaaattataatagctgtttgtctctaacatgttctcaatggattttgaaactattgtgaaaaattagtcatattttgatattaaaaagaattcttatagtcaaaagcctatgagctgcttaaccatgtctcagatcacttttacctgcccagatattctattttccatccctctccattataaggttagatattaataatgctacacaacacagaagagaccacagagataatctaagcaggagatttattttataggtaaggaaaaaggcaagcaccactgaaaatgatgggtttatctaaggcacttgatgactaaggggctggagctggaattcaaagacaggcctcctgactgaatttaactactccacactgagaaaatgagaaactcagtgtggagtagttactcataagtactatggacaattaaaataatgaaggagatttcctgtctagcctcatattgattcacctccagctttgtggatctgagaggtcatcatgttggtcgataataacattcgatcttggatgctataaatttaatatagagcataaatacaaagatcaatattttaatgctgaggaggctcatttattggctgtttatcctcagtcctttaaatgaaatggagaactaaagaaatgcaaggaataatttttcataaatttcatttaagttttatagacgatgatgactaaaggaaagcaaaggaaaagtttatgatgtcactatttcctacacttatgggcttttctctctttctctttttctttctctcccttatccctccctcccttctccctccctctttcccttcctccctcgcccccgttaatatctctaagcctcttctttactttgctcaatgttttttattactccagataagaggcacttattcttgatcttctccatccacaaaataagagaaccatggtcatgtcccgttgttctttcatgtattaagtgtttgatgtttagaagcagtggggaaggggctaaaaagcatagactttgtcttcaacaatgggaacaagattgccaaaatggccctgaaacaacatttcccaaaggtgaaattgtggaaatctagtcctataaggtgttcttcaaagcacaggtttcaatcgtcaactgtatttaggaaacagagcattttatattctcctcctggagacgcacaactccttacggcattttaaatgcccactgaagtcttgcagtaaggtaactggtgtgatagaatttcacctgttttttttttttttttttttttttttcaaatttaattgacctttaaacccatatcataccgaacccatttggggaaatgctgctttatagaattgtgtgttattctggttcaatttttctgtcatttgtatccatcagaaaacttagaatatcatagttgggtataaataacaagtagccaccagaggggaaataaagtaaggctaagcaccatctccttcctttatggattctaacatttattaaagaaactaaagtacaatattcatataaatatttactatggtacaggacttgcattgcttgaatttatgcaactcttgcttgttacttttattacaaaaaaatgatatcactgtgtgctattttttttcctgagtacacctcaagcccatttatccttcacttctatattgtagtggttctcactttaaaagtaagtttacctgtgaaacaatatctgcgtgaacttattagtgaagttttgtatgcctcctttgatcacatgagatgagcccctcttaatatcggctgacaagggtttaaatactgtttcagaattaatcatggaaaccaatgctttaggtcttttctcaaacatcaaatagtatcaacatttagtgggcaaccaacagagatttttcttttcttttttccttctttctttttttttttttttttttgagatggagtctcactccgtcactaggttgtgaggtgcagcggtgcaatctcggctcactgcaagctccgactccctggttcaagcgattctcctgcctcagtctcccgagtagctgggactacaggcacacaccaccacgcctggctaatttttgtatttttagtagagatgggatttcatcatgttggccaggatggtctcgatttcctaacctcatgatccgcccacctcagcctcccaaagtgctgggattacaggcgtggtccactgcacctggcgagatttttcttttagtgacttatttgctgctattgaaatgccatatgcattttttaaactgtaccatattcttatttttgtatactcttattcttctgtcattcttgttggaattgagtggtaacgattagtcaacacaaataatttcgttataatactccaattacattagactgaatttgtctttgtgatgaaagttgattagttgttatgatttacaccaatgaaagggactaataattcagttcaccgataagactgggaagcaagacttacaaggcattttcaagtaaatttgattaaaacgtggggtttttcttctgctctttcttaaaatgaggacagtcccctttcactacattcctaaaattaaaagtttacgtgtgtgtagagattaaaagaatagcacaatggcttgttgtgtataaaaaatatcaagttttgtatttttcaacataaataggagttgaacagtatagattgcattaaaatgtttgaatgttttaataatacaataaaatagataattaactattaacctattaaaataggtatgaactattagcataccttatgtaggtgaggattggtaggctatacttcaaaattggcaggaatgttttgcaattattcttctcaaggttattaatgattattaaaaattctcttggtattttttttcagaaacttgctcttctttattgtgtacaatgcctgaaggttgtcttagaagtaagctaggctagcactggctcttcccgtgccaatccagatgttccttttgcaggcaattactcctcagtttatttccccagtttatttcccgccaaggatttgtctttttccagggagccaattatgcacgtcttatactataatctgtgtcacttgaatctgaccaaaaactatgaaacaattcacttgttggggattccttttcacaattatcattttcctgggaaattgcctactttaggaggttgtgctacttaagatcttctaccagagaaatatttgcgtcgccaatgtattgcttagcttgcttgtctccaggctctaacacaaatacctaaaataaataaagtattaattatgtaaaaaaagtgaaaaatacctcgcttatcctctttttccttccttttgtatttacagatgtcatccatactgtagggccaatagccaggggccatattaatggttcccacaaggaagaccttgcaaattgctataaatcatctctgaagctcgtgaaagaaaataacatccgatcagttgtaagtaattttatgttttttatttctcactctttttcaacctttatgctttagtaatctgtcttgtctaaagagaggtaggaaaccatttccaaacttttgagaactaagtttaaggatcttagtagccgatttggttatcatgactctaatctttgatgtgctataaatatttgctaaatttttcatgatgtttcagaatttaaaactataaaacctcagaactggatttatcttatctactttttcctctttattttgccacttactttcttttggagaaagtaaatattatggtagtggccagcagatttaaagaaggaaaatagcaagtgctgagtttgttatgatagcgcacatttaatatatattggttgtatgcttgtgcattctggagccatgtttaatctctatgtacatgcatgaatgtgtgcatgcattctcatgctagtgtcagacatgatttatctgcaggaaattactctgcgtatgtattttaacctgaatgttgttattcttttagatttattttactcttattaaactaatattctgtaggtggtagctgggtataccacagctcttctaagttttatcagtagacaaagggagttcagaaaatgtggatctaatctatttccttaccagtaggctgagatgaaaggaattctcttctagctggatttggaggtatttactcacctgcttttcttttgcaacatgttctacctttattacatctcaattacaccaagaaaatcaaactatagaaaaacacactgtaaatatctaataataagttaatttggctggaatcccttggttgttccccctcccccatatagattatagccttgctgaaattgtggggcagaaaaaatagttaaatgcttgatttcatagcagactgaatagatcagcattgcttgatagttcacagaggtagtggttttattatttgcatgaagaaattttgagaagcagatacatttaggtaaccctggatggttgttatgctttttgtgcatgattgtaattatgaagtgcatttttcaatgcaacattggtgattctgcttgaaataaggaaacttttcatgacctaattatatagccctttttaatctttggataattattaacagagctggatattttatttctctctttgattttctaaaattttgttcgcaaatggctcaatacataagatcctattctctcttagaggtgaaagctgaagttcaaagagaatggagcaaagtataccacaagaccagttggttaattttgttctctataggaaaataagaaaaatcaaaacaggtatgcacatttagggaataattaaaattttgtcaatatggcttattgatttaaaaaagcaaaagactgaagtgcttggaaaatggatatgtagagaagtttccaacttggaaaatatggattttgaggcctgaagagaatttgctagtggaatcactggcatctctaatgacttgtttttaaaagccaagaaaaagtaagaagtaagaagtttgttagaaacagtataaaaataacattcaaccttttaatagagaaaggaatctctaactgtaattatcttaaaacaatcgtgttactctatttgctaccattaggtaagcaatggaagaattatgggctaagttaactttttaacagatggcatgcagatgggctgaagtaatgctcctgtaatactctagtcattctttgataggaattagatctaccttaacatctttgatgattattttgaagggccaattacatattacttgaatgaaattagcaggtaaggctgaactgaattcatcccaatattagtaaataaaaatggagatagaaaatacacaaaatgtgggaagaaatgtccaacgaaattgatcatcatgttttgcatggtagactacagttgccatcaaatgtcttgtctcttttacacataaaaaagaaaaatatttttcttttctttctccctccttcccttccttcctttcttcctttcttcctttttttggagtaaatggggctctcttctttatatggtgtgtcatgttcttgatcaccattaaataaataataatgctaatctcatcacattctgattatgtagagggaaatagaaaactttcagaaacatgattatgactggatacatgttttatagtataggcttgtattttgtcaacttatcacaatagatggtagacatggttgatataaaaagcctggttattaggatgaaaaataaacttaacttgaactcatttatatacatgtcaaaaagaatttctcataaatccttttatcagagtggcttagtgtttgctttgccacttattactgtgtgactgtggacaagtaatgtcaacattttgtaactttggtttccacttataaagaatcagtaaattactactgttattgcagacctgtccaactcatgtggctgttgttatagggatcagtcgggataatgtgtataagataattggaggaatggaattctctgaaaagtatttgacaatgttacttcaaatataagatgttttcacacctcatgatttggcaatttaaggaaatatcacttatttctttgatatctattctgaacaccagaactctagacatttaccatgtaatttcttgatgtttttaaacaacagggaaatgtccaggaataaattaaatatttgataggcaccacttttctgctaaggttaaaccaaaggctttaggatcacagcacaggatccaacatatatattcttattcttattttaccaaaagaatagattcttcaaatatttttaatggatgtaagacaagtagtatgataatttatttaataaatatgaataagacctactgtgtaccctgacgttatcaggtaacttccgtgacaaagagaggatctagtggttgttttctaacaaaatgtgactccatcttatgaccacctagacaaataaatggacaagatcatcatgtccactgtgtgatttgagaatactctgtagttctcttatcacttttaaatatcttcccagagatgcatgaaattccataattaatgagtaatttaggatgttaaggcattgttctttctctgcaaatttcctttaaaatgcagatactcataagatcagtagataattaattttctaatacattaatatgaagaaatttatcaaattacttttcatgttgacaggataaattagagtatgataaaagtactgagcaccttagcctgggggaggagaattggagaaaggtctgaaaggagatggagaaaaacagaaaaaagagtagggtataaataaatttcacctacctctcagttttgctaagaggagatcattcttgaatagtagagagggaaatgttatagtcatacataattatttagaaataagatactgatttgggcgtaagatgtgttgtggataaaaatttttaccatgaaaaaatactatatattttattaacttaggggaaaaaattcattacatttctgttctccatgcattgtttgtaacagctgttttttcatacctatccacatttgctttaggtggtaaaggaaaaagataaattaatcaacaaatcaaatggctcattttacgatggcatttcttttatgaatgatgatttagtgcttaatatcaggaaatatttaaatgtaagattttaatcctgattctccttctaatcttaccgtaaatcgtttcaattgaaaaaatatgaccaatctttcatgcctcctagacctagtctgtgcaagtttatttcttccaaatattattccttattccaaatattaaagtcagttatttttatttaaccatgagttacccttggatccaaaaaatttatttttatatatatttatttatatatatatatatatatatatatattctttttttttttttttttttttttttttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgctaccacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggcctatatatatatattcttgacaaccttgagattgttgattgcaagataggcaaaatttaaggcaccatgaagaggataattagcagtacaaactggaaattggagtgggaataaaagaaaactttaaaagaagaccagggagcctacagattttctctgtaaaaccttgggaaagacaaagatatagctgtcaaaaaagaaaaaagacccaggttgaatcccagaagtctaatgcatatgacctgaggaatgcatagtcagaccagtgaaatcaagcatctaaattatgttgatttctagaacaacagtatatcctgaaacaatgaaaactacacatatacatgatatccttggctatatatatctaaaacatactaacagaaatcgtgtatattggtgaaaatcttggtgaaatctcggggtgagcgtaggggtgaagacaagaaagaaaaatttctattgagccagggctggaaaatgaaaatgcctaattttgtatccaatatcaccacgcactgatggagaggatacatagatattttcttatatatcatgctgtctttattctttttgtttgtgagcacagaaatattttgtaatgatttttatgtgtttatcctgacttctgtttcccttcttttaacatcatgttcatttttaaaaaactaatccatgtcatacaaaaagtatcacagcaatttcttcttctagcaccagttaaaaggcatagatttatatttgtcaatcatattaggtatttgagaaaactattttcactgatgaaatacaatgcaccctgtctgacattctttgaatgacaacgtgtaatagagtagatgttttattttgaaaaaaacataatctgcatataagccagattttacttaggttaaaaattattttcccatgaaaataaatactaattgacataggaatttagtgattttatgtgattatgggcagactaaaacttgtatgtttgtttaagtggtgtatgctacctgtgatttccacaagcatcatgctagatgatttttttgaatgaaaaaacattgtaaatttttgttagtaggaaccacccaacttcaatagggatccctcagagctaactgatgttccttccttgagtcatagatcttgagaagcaagagcttccaatgggaaagatgatgggcctgcaaattcagtactacctctaggcattgtggcaatcaagcaattttggaattctgcatttagttgttccactgtagtgtaggttttcattttaaggcgtagtcaagtgaatcttattttcttatacaagttcccttctgagagggttgccatggcaatgagttctcagcctgaaattcttaaatgttggttttatttcattatctgagtttccattacaggccacatcaatcaatgcagttctctattcaagaacacgtctgcagccttaaaaagctgaccctttcatttggtacctctgctcctctgcctaacttgatgtcaccatttcccagacaactcttcatctccaagaaccctcttctacagggctgtcaatttgatcttttccagtttccttttaggcaatatctagtcttggttctcacctgtctcattttctcatttataaagggtaataccaagtctctatgtcttccctggttgggtttctaacagctgtgtgactaacaatactattaataagtaacaagaacaaaggcacttttgcatttgtgcatcactctacagtttacagcagtgtattcctatacatcatctcatttatttttcaaattctctaacttgctgccactgttactttgatttagccagtgtgggaaaaagctaactcaagacttttcctttcttcttttcccctacattcacgtttcgtaagatctcctcagagggcacagaggtacacaggttattgttactgggagtgacaagtgacaggacaggcagcagagtcgaggaggagggcgggcatggaatgatagtaaattcacaggctgtgccttggaaacagatagttatacaaccaaacccacattgacagatcctgcacaatttgtgtcttctggtggccacaccagagagatgatttgagttagaggggtgaatgagatcaatcattgagccatgaaatatagtaataagaatagcaaatgtttctgaactcccacttggtgccaggcactgtgttttagtcattaattctcaaaacaatcctgagttagaaaatgtgatttcttccatcttagagatgaggaatatgcaccagaaggaaactgccttccctgtggctcaattcctcatccaaggatatgagccaaaaccaaggtgatgcatatcgtgattctgtttctccactagctaagcattatgttgacgaccgtaactccatgcattctgtgggctattacactaacctgccatctgtaggttggacctgtaacactactggtcttagctcaagtgaattaaggtcttaccttgaacaaaaagttgaggtgggatttaaactgaggtagtctaaatctagtggcctaagccactgtgaagttcctttttctttcctccattattatgtgcctttttttgtctaaaccagtggttctcagtgggtgtagcactgccctctagggaccattttgtgagggtggttttgggcagtgacaacaactagggagtgccacaagcattttgtgggcagggacagggatgttgtgacatgtggtctggccaagcccacatgggaaaactgtccctcctcccacacaatgttttaacgttttgccagacagtcatataagtgaaaacctgtttataaacaccaagatacatcaaaacaaagcctctctctctttttcactgtatcctggactatcatgaaaattaaaggaagcttgtacttagtttgcttagaactttaccaagagtgcctgagaaaattatgctacagatggccatgcccaagcagcaggagagtttttcacacctggttgagtccacatttagagaattttttttgtagtgattctacgtagtgaagcaaacatcttccttcttcattgcgtgttctagtgtattcatgcccttgtctttacatgttgaaaatagaattttactataaatactttcattttaaatcattttcatatcacacttatggcactctattgattttttttaaattgatgtgttgttttcatttggcttcccttgggaacagaccctgagccaaggtgttgtgtgcacgtgctttctataggaggtgatgacagggaacagcgcagaggagtggggatgtgaggaagggaagaaaaagcagccaggaggagtgggagtgttataagttggcagtgtggacaagtggggctctgtcttgctggggagctctcagcaaccatgtagaacatgcctagaagtggtcccatctgagggaggagaaaagctggactattttttttttttatctttcccccttcatcagctggctgaggactgctcctgggtcattaacttcccagcatttcttatctgcccgcttgggcaggcagaaggaaaaagctcaggcagagagtgacagcaagggtatttgctagaagatgctgtggatgggcatgtgctagaatgatgagaactgggcagatatgggtggggcactgatgcctgtttcatgtgtgcagatgagtgttaatattgataaatgtcatttctgcatagcaaggggactttacaaaatatttgttataaaagggtttgctgagcctgatagaattgagagcattggtttaagttaaacagagtttctaatagagcaaagctacattgaatatgctaaacacaggttgctcaaagatttttattcttaaagttaggcatccaaattatctgcttctttaagcatagtgtgatatagatgtcataaaaatggtaattgatgtgactggccttatatcctatagaatacatggtcttatgaaagtgaatgtaatgcttagctaatagaaaaacaatatcacgtgttgtgtcaccttagttaaagttttttcaagatctcataatcctaacctttgattcatcatgcaaattacggaagagttggccacccaaggttgaatgcatgtaaagttgtccatcaatcagaagacacatattagaggtgagcaatttaagcaggagtctacctttgattttattctaatataaagtttctttcaaattatgtgttctttcaatgatttgggaaatatattgtcatatatttccttcaaaaatcttactttaggaccgtgatcaattctttttgtaagagtgtctgaaactttttgctttatttcatctacaatttgaaagaattatttttagtcacttgtatattctgcagatgtaagtctactagcaagaccaagaaaactatgtttaaaatgaaagtataaaacatctcaatttggctggatttgtcaacataattattttctgttcttttatcaggctagggaacattctcaggaaaatcattattggtttctacaacagtgtcttccagaggaaatactggcctagcacactgtcaaagagagtatattacagtgaaatttgtatagaaacagtaaagagatttgcaatgcaagctttcatcttgagtgctttatttttccctgacctgagcggcagttattagatcactgtatcatgaggaaatagtcaattgaagacacggaccacagagtcccaagcctgacattaggtttgaacaattgggcaattttggcatatatctagagggttaatagtatagagcaaaggcaatggctttaaaccaaacattttttcttgcaaatgttcagatttttttttttttttttggagagcaattgcaatgtatggaatctaagctattcttaaggtgttgaactcagaaaccaaaggagaaagaacaagtaaaaacaataaaaaatttaaaataaaaacaaatctgtcagtggaaagaaagctttcttgacttgtttatgtacaattcaatggagttgcaaagaggattttttttaatggaaaacatgtcacagattgggttcaagctgcactttagctatttttgtttgtttattttatacacacacaaacacatacccttcaaaactgtgcaaagtgaaatatttgctttcctggatgtcttatcaaagtggtatagtttgaatttataattatgaattaagttcagcagtatattaaacacctagatttcagcccatacgagtaactttagtgcagtctctccatctcttctgagcccatgttctgaaaatttccctgctcccagtatactagcaggtaagctatcccggaggatgcacaacagaaaagcttatagaccaaattaagaggcatgactcacattgactcaaggagaaagaagccaggagaaagaaagaaataggttaacacacttagactaggtgacaaatgtgtggaagaacctcattttctggttatgctgtgtttgaatgctctctttaccatctctaccctctcaatggtgatgtggttatgaggaccatagttgaggtttgaacaagggagcatggcagatggtgagtgcctggggcccactacacacacttgctctatcagaaagacaggggcaagtgggcctggccggtatctcatcagttcattggtgaacagcaggggggtttacctccatttctgtcagagaagatgtaaggccaaatgagactataatgagtatcaccaatgggaggataatttgaggataacattgctgtcactctagaggtgacatgattcatgcttctgacctgttcttaccattcttttccattttgaaatgacagtcttgtttgttccatcctttttatcatatagcatgtcttagaggttacttagtactgcatttaacacaattctatgaatcctgcctatatctcaaaatctgctcgcttagttattatcaacacttaacacgagttatatatcccatttgtttttattttcttctatagaagaattgaatattctcaaataatacagcaagcatattacactttttataagatgggatgacagctaggtgtggtggtgcacacctagagtcccagctactcaggaggctgagacagaaggatcatttgagcccacgagttagttatgatcgcaccactgcactacagcctcagtgacagagtgagacccagatacccagtctaaaaagaaaagaagaagaagaaaaaggaaaatgggataacatatatcagtaactaatcattttaactgggtgatgggcaggttctatgtatggactgaattgtgtcccatcaaaattcatacattaaatctctaacccccaatgtgatggtatatagagatgggacctttgggaggtgattagacttaaatgagttgataaggatggggccctgaagatggaattactgctgtgataataagagacaccagaggccttgcttcccctgactcttggcttctcaaggatacagctagaaggcagccttctgaaagacaggaagagagccctcacaggggaacagaattgtccagaaccttgttcttgttctttccaacctccagaactgtgagaaataataaattcctgttgtttaagcctcctggcctatggtattttgtatggcatccagagctgattaatgcagtgagtatgcaggcattcattatactattctctctgtttgtgtatgtttgaaattttccgtaacaaagcaaacttaaatgtttaaatatataaaagagaatgatagattataacagtatgtacttcctaggattattgtgaggctataaagaaggaatatttgtaaagttctcagtagattacatagcttattaaaaataatttacctgacagatatgttttaagcaactattatgtttcaatcactggtcaaagtacttgagatatagctgcccttgtggagcttacattctactgatagcagttttcattattgttaatagatggtttcacatcatttctagatgctgtgacattcattattattacattcttgggcaattatctcattaccattgcatttttttcttatttttgtgatttctgaatctttaaaaagctaagaaggtgatagaactgagtagagatccagcaagtggcaattctatgaaatagtaataatataaccctcagttaacatacatccatacaaacagacaactatgtaaccaggcctgtattactgaagatcatgttttattgggcagtatggtgaatcaatcaggacgctgtcttgcagaacaagtgaaacataccactacataaagtcttcaaaacaatgaaaatccagaaacagcttctcaagcatttgatgtttttcaatgtaaaaaaatagatatttagggtatttctctcaaaaaaaaaaaaaaaaaaaggaatagctcaaatctatgctaaatactttaaattccttgggctatttggctaccctagggaaacaaggactcatagaaattgtggtcagaagcatgaataaggaataggtgacatgttctgttgctcacaatagaaccaattctccattaggttcaggctttattttttttccttcaacaaaatgcaattagattctccaaggcatgtattaaatatgaaagaacagacactgactttgtagtggagaaacccagcagataccaccataatcaagtgatcaagattaagataatcagtaatgagatatgtcaacattatgaacctcttggtataatggatcaagaaagacactacatcactgctatggtattcttgccatagccacagtccagtcataaccatagtctaatcatgagaaactataggcggacctccaaagagggacattcaacaaaataggtaattaatactcttcacaactgtcaaaatcataaaagaaaatgaaaagctaggtttattcttctcatattgttatggcatattacattaattgtttttcaagtgttaaaccagccatacattcctgagataaatcccatttagttgtgtcatgtaattcataatcatttttatatgctgttggattattttttatataataagtgtttgagaatttctgcatctatattcataagagatactggtcttcagtttgcctttattgtgatgtctttgtttttggtgttatagaataacttcagaagtgttatctcttcttctattttttgagagagtttgtgaagcattggtattctttaaatgtttaggagtagatttaataatttttaagctatcgtaagaaaacatttatttagttcatatttgtggtatctaataaatgaccaagaaacaggatctagtagtatatttttaaaaatgtaaaaattagaaattcatagcacatgcattttggtttttaaattaaaaatatttgcttacaggttttattatttcacagctactttgccaagttttcaggttgtctttctcaggaaccactctgggatggaggttaatgtgcaggacgctaatatggaaatgtttttgcaatcaatatctgcagaagggaagaaggaaacagaattgggcagagggagaagtcacgtgatgatgcaatgtttatggagcatctggtgaccctactgggagctctaaagctgagatgattgtttcaaaatggttccaagttggtgtgaggagtctagacctgtacattctgagacaaccagttattaatgcaggctgcacccaggaacgaatgtgatcttggaataagtagctcctctcagtcaagggtaatttctggagagggctgacagctgagggctgtcttctggcaacatcccttgaagctggggcactgtcctgcacagagtctgggtggtgcatcacagcacgaactgggattcttaaactgagcatgatcctgctccaatgcccaatgtatttgacagttatgtattctctcttggatatggtttaaaatttaacagctctaggaaaataagaactgaggcaaaataccttgcttcaagtgatgaaaagggtaataggctgagtattctgtatttactggtcagagcagagtcattttgatctacatgcacacagtagaatcgaaggaaacagtcctcatttttcttggttatctggctcatttgcaggaataacacacacacatacacacacacacaggtcaatatatgtggatcttaaataaatatgcagtggggccaacttgtagtggtttatgagaactgattgttaaaatgtcaagaattctgtgagctggccgggcacggtggctcacgcctgtaatcccagcactttgggaggccgaggcgggcaaatcacgaggtcaggagatcgagaccatcctggctaacacggtgaaaccctgtctctactaaaaatacaaaaaaaaaaaagaaaattagcggggcgtagtggcgggtgcctgtagtcccagctactggggaggctgaggcaggagaatggcgtgaatctgggagatggagcttgcagtgagccaagattacgccactgcactccagcctgggcgacagagcgagactccatctcaaaaacaaaaaaaagaaagaaaattttgtgagctgattattaaaacacaggctttattaaaaattaaattttataaactcacaatttaataagttatattaaatatgaagataataagtactcaatacacagcaattcctaattactatattttactattacctatgccctttggtttatttatgtctattatatttatatggtggaaatagtatataatggtgaatttctttgcatcctttccaattctatgttcagtgacatcatatagatagtataaaattttccatgttggggctatttacatggcagaaaccaacaaatgctaaaaatcagggcttgatgtactattttgctggttaatgagacttaagaaatcttgtcagtgctataaatattagagaaaaagtacactagccatagtaaggtgatcatattattactcatctaatagcaacaccaaagcaaaatctgctaatttcatgcataagtgatggtttttgtacctggacagcagggataccaggggaaggctgtcagctgcctagtttgggtctggagacatggaagactttgaggtggggagtgccagttggtttgaggcccccctgcaccccagattgctgttttttatggttgaataggcagacacttctttccctctcactactgcaagtgtatcattccagaaggtatggtttggccaaaaggcatagtattcctaaagaaaggagttccaatagcttttctctgctaaaagatctcagggtctgattttattttgatattaagaattttacctaactaaaccctagtacaacatttttttaaattatgggtaattaaaaacttccatattttaaacagtagtaaaggcacactctgcaaacatttctgtctgcattacctaaaatttaatggatcaggcaaatgatacaaattaggcacacatttgccaatatttttaattagcctactggtttacctgcatacatttgttactgtaagttattacttataagagttacttcaaattcaagatcagcagaactctccataaaattatatacctgtggcactatcaccaaaatataacatcatagacttgtcataaataattcagagatttgttgtaaccattcaacatggtagtgttaatgtgagacatggagaattagcatttgaaatggataattccatatttatttcatgccttcatttattttacacatttaactgctttggtttaaatggaaggagaatcctttctcaaaattcaatctcagctgtcttcttttcaggttaatggttgatttctttcaaattacaaatcttggttcaacataaggatgatgacatattgcagaaatacctttctattgcttgaaatgagaaaatgtatttacttattttctgtgacaagtgagggggatgctgttatggcactcaaaatgtatttatggtatttctattagaaaaaaaatctcaggaactaattatgaggcaaggcactggcaattctattgttgtattcaaataactgtgtggcaacttttccaattttgacaaatttggcttaaataataattcaatgatgcccctcaagtttcaaatacagacagtcccttacttatgattttttagttttatgatggtgagaaagttatatgcattcaatggaaactgtacttcaagtgtccatgcaaccattctgtttttcactctcagtacagtattcaataaattacatgatatatttcacactaaattataagctagactttgtgttgaatgattttgctcgacggttgtctaatgtaagtgttctgagcacatttaagatagagtaggctaagctatgatgcttgataggttatgtgtattaaatgcattttcaacttaccatgggtttatcgggatgtagttttatcataagttgaggaacatccagatttgcacttttctaacagcctatgttgtgagcaaatttaaagacactgtgctttcagacaaattaagaagcatttttaggaactggatacttcagctttagataatagtgtgcatctttctaaaataactcatatgcaatggcatgagtagacatgtccagatgtaacgaaccataggctagaatcatgtcctaaaacaatctaaagaactacagacacatatgcctttaatgctaataaatcgtcttatctcagtgtcaaagctattactacaatttaagtttaacctctttggaaactttctgttagtatattggtattttggtgagtatatcattaaaccattaacatagtgaatagggtgctcatacatgaatgtaaatgtgagtgtatgtgtatgtgtgtgtgtgtctgtgtgtgtgcactgtgtatccacatcacttcctttccctgagttaccaaacctgagttttttaggggccagcaatccatgcctttacaacactctgatgttgatgtggttttataatatctttgtggtatcacagaaagaaagttgacctagaaatctgaaaactaatatttgagttttggcctttctaattaattgctgtgtaagcccatctttttatttttttttattagtgaaatgaggaaaacaagatcttcccttaatcaaatcaatgggaaataacaagggttaatgaggatattaaaaatttgaaactcttaaccactgcagtggatgcgtaagatgatatagttgtggaaaacagcttggcacttcctcaaaaagttaaacacagaattatcttatgatcaaacaattccacttctaggtgtttacccaaataattgagaatataggtctgcatataaacttatacactaatgttcatagcagcattattattaatagcaatagccctaaagtggaaacaatccaaatgtccaccacctgatgaatagataaacaaactatgatccatttgcaataaaaaagaatgaagtactgacacatggtacaacatggatgaatcttgaaaatgttatgccaactgaaataaaccagtcacaagaggcctgattccatttatctgcataggaaatccgtagatacagagagtagattaacggttgtcagaggctggggataagagatgggaatcagggaatggggtgtgactgctaatagggtatcttttttgaggtgatggaaatgatctggaattaaatagtgatgatgattgcataactgtgaatatactaagaacactgatttgcacactgttaaatggcaaattttatggtatttgaattatattacaatttaaaatttaaaaaccttgtcctgtttatcctggaggattgttgtaggaatgaaatagaagtggaaagttctataggctctaaatcatattcaggaatccatgccattgcatggtgaagcacgtaggcctcagtgtacgcaacttgataaagagagtttgcatgaaaagtcatctttatgttgggtaattgggggtgtcacatggagggttatcactcagaatgcttgctgtgaagagctttatagaagagttatataaattacacacaaaaaagtatttttttaaatggaaagcacaagagagatggagataaatcgaactttctgttgggacctgccactttctgctttacatgttaatagtgactgtataataactgtcttcctaggctgcgaaaccctgaaggatggaagcttcgtgtggttcatctccattactctgcagcaccctgcgtatagagagtgcacagttagtaataaatgagctttgacagatttttttttttttgagactgagtctcactctgtcgcccaggctagaatgcagtgacacaatctcagctcactgcaacctccacctcccaggttcaagcgattcttgtgcctcagcctcccaagtagctgggattacagacaagcaccagtaggcctggctaatttttgtatttttagtagagacggggtttcaccctgttggccaggctgctcttcaattcccaacctcaggtgatctgcctgtcttggcttcccaaagtgctgggattacaggcatgagccaccgcacccagccagacttttctttttaaacaatatcctgtttggaattctaagcaaagtcagcaggctactgaatggacttcaagcaccaccctctgggacttcacaggctgctcctctcttgtttaaatgtggaaggatggaagctcaccccaggactctaggcaaagccagaacttgaggtcagcgcatctcacactgcctctaggccaccagggcatgtcttttccaaactctcttagggctgctctctgtgactttcctggtgtgatcctcaagccgtcctccctgcatctgtctgtgtttatctcacttgagctcactgcagtacttgacacttgtggccattcctttaggatgcttgcctctcagcttccaggacaccactctcctctctttcctccttcctacttggctgtttcttctcaattgtctttgtggccacctctggcttaaaccctctgtgactcctttgttcaccctttgctcttcttgcacagcagtatatctttacttaccagtaccagtcaaaccctaacactggtggtataggggcttcagtgactacaagtccctgattcccaaatcatggctcggctaagacctctgtcttgatctccattactgaatatccaactacctggtggaaaattccattgcatgccccagagtccgctcagtctcagtgtatctcaggcaacctgcttggactcctgtaactaatgccattgtgaatgtcactgacatgagtcttatgcagtcagaaatccaggagctgttctaggtctctctgcctcacccctctccttccagccagtcatctcttgcagtcctgtagacaccccctcccccacaagaactctcatatcctttgtcttagtttctgttctctctgaagcaaaccctgagaatgagacaagtacttggttacaaggaatttattgggtagttcatttttcccaggaagctccatgagggagtagggaagtgagacagggaagaagcaaaaccaataaagagtgtgttaacaaccaggtgattgctaatggcaactggggcacagtttagctggggagcttctgagaaggcacgtggaagctgcttcagaattgccccgccaaaggacaaggacgctgaggtatttgtctaccaacccctgtcgcctccttgttcgagatctccctcttgcatagctagcaccttgagtcagtgatcaccctcaggcagtctcaggaggttatctgtggctatgggagtagtctgcaggggaacgctgcaaagaccaggagcagggtgacagcccaagagcttctgtggtactgtcttctctactctctcccagccaccattttctgtcacttctcagctgaaccactgcactggtctccttgagactttaaggtttttaaaatttctttgtaactttttgcacatcctgccagaaagattcacacacacacaactgaccatagcatacactccttccctctgattagagatcttagaggctcctcagagttttcaggatgaagcctgattaccttagcatgtgcttcccaatactccaaggcacccaaggctccatagcaattgcatgggggttggacaggatactgtaacatttgaaaaaaatgcagttctttaacatttgttgggcatcctggtaactattagtttaaaggcagtctacagtttcaaaattagatcatgcaacgttccttttcttgatgctacgttatttccaagttgagttcatgactattgctgtgattaaaaagcatatgcagaatgacaatccatgtggaaaaggaaacatgggcggcaggggccgagctggttcaaaggtttgaggatttgcacagcgccaacaggaccaccatcccattaccaaataattgtggttatttaagagtgaaatgtaggtattatttttccctttatatgtatgacttttaaaaataggtactgagctgttagtattaaacccttactacgttgtttagacttatctacttaagaaaagaaacttttaaggcatttctttacctaaggccctggccaccctcttgtgtctcctctgctgccactcttaaatacaaatttttggctacctggaaggtccaggaaggtcatcatgcctttgtttgtgatagcacagactattccatctgtcaagattaccttcctcacctccccaccaccttcaccagccctacaccacacagcttaaggtgcacttctgctaggatgagtctctgattagtgttttttgccccaggtattattttgttgcctctgtgtctgcacagccttttgtacacagcttttatgtggcaatattcttactatacccccactggtgatgtacttgtctatctgccacattgttccacgatttccatgaactccatgggcacagacgttgcattcgctttgactttgctggcattttttattgggattatgtccatttagcttatgataaattagcatgagtgcctaagatgggatatagattcttgaaaaaaggtgaacatataagtcaaaggattgagaaaaatgtaagaatgtatgtgaaataataagcctttactctttttcttcttgtttatcatttcaacattttatgttgtgattttctgtgtatatgccacaggacctttgcatatgccatcctctgtgtttagggggatcttccttctcccttcacctgagttacctgcctcccttcttatcctttggatctcagctctgtcttctcttccttgggaaaaagttttacatttatatttgtatgcttatttgaatatttttcttcttcctccccagttcatgagctccatgagggtagggacaaggtctgccctgctaattattggatccataattgagtatattgcctaacatgtagcaggcattcagtaaatgtttgtagaatgaatgtagaatgaataaatgaatgttgaatctatgaaagcttcatgtttgcatcaagacctgatgactattctgaagcagtgggatgtagtttttccaagagagagtaggaatgttgtctacattgtgagaacagaaaggatttaggcaagggccagcagggaatggaattttagttccaagcttgaaagaaattgggaatcattttaggtttccgaaaaaaggggtaggggtcagatgatcaaaattgggctgaatgcaacacagaaagttctgtttatttaaccacttgcaatatttcacttcaaaatggattccctgccactgagaagctgccatgttttcatttgctggaacgtggtgaagttagataaatgataatgccatgtctttgttcattcctcagttagaaagcctcagccttaaatgctccccagtgcaaattctcactgaataaacatggagtgtattgttttacaacatgctgctcaatgacattgcagcacatttggcactgctgagcatttcaggatgaggaggcagaaaataacaacagcaaaaagcccataaaacaaattgcatcccctatattccttaatgaaggacttgggtgtaagttgcatcaacgtcagagaatactcattcattgcaaaggtttgggaaaatcatatttatgcataatctccttgttctcaatgatattttattaatatttatttcccttttgcctttcatctggtgttatcttcttttctttttcatctttattttccaagtgactagctgaaaagaaaaacagtgaatcggtgctaagttgctattttttcaattttaagggactgattcttaatcaagttactattttaaatgtttaaattgagaaagttccgggtaacaacctaaaaaatgtaaatacataccacacagttaattaatgtttctgaattgctactgtttgaagttgataagccccatgtatgaattcctcagctcaaagctgagggagttatattaagaagacagtagaaaataaaaataattagctagtgttttgtaaggagggaacataaatggtatctgtgtggctctaactttatcaattcagtctgttgatttcaaaattcagtcatttgagatatttggtattatgcagattttaggcagcatgtgaacaaagggctaaggtaaggattattgtattgcatgtatttctgtgaactaattttgaggagctatactaggcttctgttttatgtgtatctataagcattttacaaaacaattccatatgtattgctaattaaataaattcatctcaaagtttgttacaaactcaatcaagtgtttgagatgtagaaggaacatatagtttaatcctgtaccagtcaggatagcctaagtcatgctgaagtggcaagtgatctcaacatttctgcagcttacagccacaaagattgagttcttactcaggctagatgtccatagaggcagctccagctccactacacatcaccttcactctgggactggctgacagagctgtctctctctggaactgttgcttgtcacaacagtgagagagagaaggcggttcttaaagctacatatggcttactgtcacatttcattaactagaagaagtcattcggccatacctacattgaacaggacagggagacaaagagggataatcctccctcaggaaaaaggtatcaaatacttgtgattagtctaccactcactccttcatattttggatatgaaaaacatcaccagaaggattaagaaacttggccaagatcacttgcaaagctgggattggaccacattcctgtgacccaattgcagacattcctgtgactacatccagtgtctccttgtatgcaaatttgtggacacaccatggcatccacagactcaccagagaaggatgccacctacagagccagctgctcaccagagcctggcttgcatcatggcatcactttgatggggtcagcatattcgccccttgactctgtaggtccaaaatttgcatctgttaatgtatgctgtatcagtcaggattcagtcatggaggtagaaccgtatacattttggtgcaaggaatttattataggaattagtacttaaaccatgtgggaggaactaggaaaatgaagaaacaagggaggagttgaaggccaaaccagctactttgataagccaagtgtgttcagtcatcaaaataggcaggaaagggaaggtttttgggagtccagtgggatgttgggcttcggtgtggctaccactgctgtaggaccaccactaaccatttaggtaatgcctatggctgcttttgcactatgacagcaaaattgcatagttgtaattaagactcaatgacccacaagcctatgatatttactatctggccttttacaaagtttcctgacccctggtctatagttcagaagattgatttgctgatctatagtaagaaactcagctatgcagcaggtccagcaactacacagttccaagataagatatcatttccccattgttaaatctatgtgcaaagctaacttatgattaaattatggtaagcttaactgtaatacaaggaatcatttcatactatttgtaaagcagtgaacactagcgtaataagttatgatcgtggaggctaccacctgcaccatccataccccgagggctggacactcataactatgggtgaggccattccttccgctggggcaagaataactatagatgcctatgggaaactgatacaatctcattctctacacttcctttatatgctgaaggtcacaatctttattcttgcttagtgaagagagaatcgactgagctacatccacacactattcaccataatgagaattggaatattacttcaaattctgcagtcaccgaagcaaaatctgtaacagggtggatttcaaaaattattttttatcaaggcataacctcatttattttaggttcatggatgtaattttattctccaaggtaaccttatcttcaaattttataggtctcatgctgtcccccatcctgtatcacctacaggtgacttttccttgatatgacttatagaacattaacagtgctttcttttcaatcatactccgatttggttagttccaacttaggggacacttactttaaaatgtctcttcaccctgcaggaaacgagtttattagtgaaactttcaacggatatttttattccatttatgccatttatctctccatgccttgtgaggcaaaggagtggtgtttcaccaggttaagaggtaattgatcaagattcagttcaaaaaaagtgtaaacagtacagatcttaactctcttcagtacttttaatcaaaaaggaaaatcaaagcgtatcagccagaatcatcaataactcttggtggatgttcaaatgcagtgacctcttgacacttccactgccttcagtttttgtttttatcatttgttgcttagcagcacggggggaaagagcaggactgtagcttggatttaagctcctcatttactagctgtgcccttttatcaaatcgtttaatactgggagccccacttttctcatctgtagactggggatattaatggctcctatctcaagcagttttaagagttaggtaagttgatattgaactaatttgacattaatgttaaatacttatcatagtacctgagtatacctgagggcatatccttcattcatctaacaaacaaggtgctaaagacactattataattatcacagtagttctatgaggttgctatgattatcttttttgtttgtcttttaacaaagaaacagagaatcagagcagttaaatgacttccttggtcataatcctagagaattttagagctagagatagaattcagatctatctgactacaaagcccaagcttgtggacttaccctccatttgtcaaacgtgaattccttgaattgtaaaccatttggggccaaagcacacctttttttttttttttttttttttttcagttaagaagctggtaattgagtgaacacaatatagtggtacttcagttaactggagctcctggggatacatcattctggacagcctagcattccagaaagctttgggtatttgccaaaactttaaaaatgttgtttaatttagatagaaccctccataaaatatatatttctctatcttcttaaacagattatattgaacctgatttaagattacattaactcagtcatttatcatcgtgaacttcatttttatcctgtactctctaatgtaagaagattctgaggttttattgaaataaagagggatatcattgacctagtctgttatgcatttttaagttcctgtgtttgatttgtaaagtttaggtgcttcctgtccaagcacttgccacttctctttgcctatttgaattgtcagtctcccacaagaccacctgaaaactctgttgacgaagcaaaactaggtttattaaacctatggtacaattggcaatcatcactttgacagtcttggcagtatttcaaaatgagggaattaggttgacatttacatggtagggtatgaactgggtggttttaaggtgagtctcacaagataggaaattgtctgggattgggtagagttgataacataagagctctggagggcacagtgaggtgaaagatttaaagcaagtgttgatgatcaagtcattggtagtaataagcaagctctttcagttgggtcacagttatattttacaagagcacgtatttctttgagtaagaagctcagttatttttgcctagttccaatattaaaataggcaggtatgtctgatcccaggattgtatggtataaggacaagaaagcatattgatttggtctctcacttgactctatgtcttggtgcttctacatgctatggcatgggacactcaaaactggaactgtatggcaacagagatccagtaaaagctaagtgggagcccaggaaactgacttacacacatgagttttgtgcttgggcttgtgacatccatttttaaaatgcagagactcctttttttcactcctttttttcttgcttaatccctggatatctttctaatgtcacgtagccaacaccatcaactaggtgagcatcagttaggtatctatttctgcactgggaatcttgaatttataaatcctggtcaaaagcgagttaaagagatttttaaacaattacacaaagtaattcttgtgttttatttattcagtttatattgagttttttgcagctcttactctcctcttcttttgtgtttgaaaatttaaaaagtgatgctgtttggacacgagatttgttttgtaaacatgaaatttagaatgtctggggattctattaacactttttgaaaagatattgccttgttctagagttcttgagctattatataattgaagtaaatagcctgagaacatagggatttggtgtggaatacatggaagataaagtgatcaagcaagtttaaaatatacaattagtacctaaaataaagtgagtattgttttacatcttcaatctagtagtcggcaaataataaaaaaaggtcaaaagtcccaattatatagtaactatcgaactggaaaaagaaatgaatttgactcttactacttaaaacttttagctgtttatagtaatttaaaccaattgaaaataaatgttccagccagcaaaaatcctttctaagaactatgtgtggtaagaggatacaataaactaatcaaacaaagtttctgaagtctcattaaccacggaatttttagtgaaatggcatggatatggtatacttggatttatttggaaatgacagaaatttcctaacaatatttgaagcctgttttggtgagtgctatcaagggctgtttttctttttcttttttctagttatatattcagtactataaattgttggcagctggcccagaaaaagagcctattttcggaaaaaaaaattattctgcaactttatgctataacttaaacacactaaaaagtgtgtttaaattttattgtcagattaccagcttttatgcaggtagactccgtggaaaccataggacaatgacaaagttgcttcttttctttctcttagctatttttttactctggattacggtgtggatattaatatatatactttttatcaagtatagggaacaaaaagaaaacctgcctgcacatgtaatctttcttacaatatacatacctgtgaaacaccagatgagaaaagctatgatctgatttatgtcatgcgaaatgaatgttaataaatcctatttagtcacacagatgccaaactgagacaaatggaagcctctgggggcaagtggaggtgggcaaatgggctccactgatttatgagtgcagagtcatgaaattgaattcggcaacctacaaatgacacttattgagaacctatcaagtgctaggcacccatgctggtactttgaatacagaaataaaaggtttggattgtaaaaatgtcacagtataattgacaaataaaacaagttaattaaacaatatggtaagcaatagaagtgcaccctgcataacaatgttttggttaatattgatggtcccatgggatcataatgaagctgaaaaatttctatcttcttaaggttgtaacacaatgcatgagtcatgtgtttttggtgatgctggtgtaagcaaaccattctgtgctgtcagtcacacatttatgtacagcacatatatatgtatagcacacaatacttaagataataaactatattattgttttacgaatttgctatacttcttatcactactttagagtatactttttctacttataaaaaaatacaagttaaatgtaaaacagtctcaggcagttccttctggaggtattccagaagaaggcactgttatcacaggagatgacagctccctgcgtgttattgcccctgaagacctcccagtgggacaagatgtggaggaggaagacagtgatattgatgatcctgacttctgtgtaggcctaggctaatgtgtgagtttgtgtcttggtttttaacaaaaagttcaaaagtttaaaaaaaaaggtaaaaatacaaaaaaagtttatagaacacatatatatagaaaaagtattttttgtacaacatacaatgtctttgtgttttaagctattatttccaaaaagtcaaaacgtttaaacaaattttgattttataaatttaaaaatttatacattaaggttactttattattgaagaaaaactttttaaaaataaatttagtgtagcctaagtgtacagtgtttataaagtctacagtagggtactgtaatgtgtgaggccttcacactcactcaccactcactcactcactcctgaaggcagcttctagtcctgaaagctcccttcatggcaagtgccctacacaggtgtaccctttaaagaaatcttttataccatacttttactgtatcttttctatgtttagatatgtttagatacacaaataccattgtgttacaattgtctgcagtattcaggaaagtaacatgctgttcacatttgtagcctaggagcaatagactttaccatacagcctaggtatgtagtaggctacaccatctaggtttgtgtaagtccctctgttgatgttcacacgatggtgaaatcacctagcaaagcatttctgagaacatatccccatcattaaccaatgcatgatgacaggtaaaaaggttgattactgccaaatagtacttttgaaaaagttaaaactaggactttcacacaaatatgaaatgaatatatgtcaaagattttgttaaacctattgataaatgagagaaccagtaaagtgatagaaccagttcaaggaacgtttgcagagctagatattcataggcaagttaataaaggaaaattaagataagattgctaagttagagataaaagcagctaatttcctacaggacaagagagcataacttttggaattatcatttcttctagatataaataattattttagtctctgttgaataaaagtctacaaatgtagacatgtaacctcactaaatctggactcttttatcaatagtaattggtaggttggacaaagctcatctccatagaaattcaaggatgcttctttccccccatacaacattctgctgcttatcttttgccttattttcaagttttgggtaattttttaacaacaacaacaacaacaaaatttaggagcaatagcatatgagacagaggaaaaacagtgggattccaggcttcctcactgggctttgttaagcagaaagttaaggagagaagacacctgagataggccttctacaaatgagaaaatttccaataggacaaaatgtggggggagctggcataggtagaaggaaggcaaaaacaggtaaatcccaagaaccatttgacaggcaatgttgtatttacttttgtaacagatatagcactgtgactgggggccagtttatgagagacattactttatactttgctgcatttgttgtggtgatggtttttttaagttagaaaatcagatcatctgcatactgaagagcagttatgagtcagttgtttttaaagccatacatttatatgttagagaatttaaactctttcagaggaaaatgcaaaagcaatgaatgtagaaggcagtgaagacagagatgattttaatgcacccaggtattaaaactgagcagagcctctaattattcaacattattctgaaattctctttcatcacaccataggcttttttttccctcttcttttctatttcacctccatttcttttctctctggccccagatatgaaatgaaatctgggagcaaccacaatttctgtctcactggctgagcaggatgcttctgaaagaagcagcatctatatatagtttttcttcttaggctgcaggtgtgggatggaatagaatgaaatggaacagaatggagcaaaaaggaatggaatgttatctctcctgaaattttttttatttaaattatggatgcataatagttgtacatatgtatgtggtacatgttatattttcatataggcatacaatgtataatgatcaaataaaggtaattgggatatccaattaccttcagcaatagtttttttgtgtgttaggaacattccaatggcactcttttagttattttaaagtatacaaataatgattgttaatcatagttgccctattgtgatactcaatactagatcttatttattctaactgtacttttgtgcccattaaccattccctctttatcccccctccccacttcctttcatagcttctggtaaccatcattttactttctatctccatgagatcatttttttttttttagctcccacatataagtgagaccatgcaatgtttttctttctttgcctgacttatttcacttaatagaatgtcctccagttttgtccacattgttgcaaatgacagtaattatttttaatggcttaatagtattctgttgtgtgtatgtaccatttttctttattcaactgttaaaagacacttaggttgattgcatatcatggctgcagtaaatatgggagtgcaaatatctctctgatacactggtatcctttcctttgattatatacccagtagtgggattgttgggtcatatggtagttctgtttttagttcttgaaggaacctccacactgttctccatagtggctgtaccagcttacattccctcacaacattgtatgaaggctcctcccctctctccaaatctgtgctagcatttgttattgcctgtcttttgaattaatctctttctgctgttaataatgtaataatgtatttacttagctccatttttctctttgatattaatttccattttgcaaaagaagtcacattaagaaatgtttattaatttaaaatctctttactaattgggctttgccagtaggtaataaactatgggccatgaggttattcaatcttgcagtattttttccaggaaggtggtaaaatatgaccatagaacaaactattggccttgctatatgagctgctgtgattagacatttccaagcccagcttaaggcaacatctaaccagaagagctctaaatataaaataaatgaggtgctgctctagtaatccatttatacacagcatttattttagccattttttttcatttgactgttggcagtcgatcattggatttatacggtttggcattgatcttggagaaggccagtttggtgcccacgtcaaacatgcccaatattctattgtccatgtgactccctagaattaattagaaaacatttcaaaagggccactctaggatttaatactatcaataatagttgtttaacccaaaatatgatgaatctttgctttatttatttctaattgggcagttttgcattttgccgagtaggattaataagcaggttaagtctaattggcttgctttgactgaagggctgaatcatttcaatatagaaacctgtactttttataatttgaaaaaaatccacccaaatcaatcctgaacaatttttattttactttctcaatttttctttttaggtcatttaaacatcttgggtccttttacatgaacagcaagactgatgctttttgaagaaaagtctgtcttcagatagaaaaggcttctgtttgtatagaacaattagctaaaattagcatgtaaatttgaacaatattatattgtgaagctgattgggcctggaggttgggatgcaagtaacttctcttgtttattgtatgcaaatatagccacttagctttaattggacattgaaacccagaacaattatcaacaattgctttagtattaatgcacagtgggaactgcctatcatgactttttatttttttcttaacatttaatttttaatttttgtgggtacatggtaggtgtatatttttagaaagtacatgagatatttttgaaacaggcatacaatgtataatactcacatcaggttaaatggggtatttatcacctcaagcatttatcctttctgtgttacaaacaatccaattatactcttagttatttaaaaatgtataataaataattgttaactgtagtcactctgttatgctatcaaatactagatcttatttcttctatgtaactatatttttgtacccattaaccatccacacttcccccttacacctacccttcctagcctctggtaaccatcattctactctatctgcatgagttcaattattttaatttttagctcccacaaataagtgagaacatgtaaagcttgtctttctgtgcctggcttatttcacttaacacaatgaccttcagttccatccatggtgttgtaaatgacaggatctcattatttttatggctaaatagtactccattgcgtatatgtaccatgttttatttattcattcacctgttgatggacacttaggttgcttccacatcttggctattgtgaatagtgctgcaataaatatggaagtgcagatatccttttgatatactgatttcctttctttgaatgtatacctagctgtgggattgctggattgcatagtagttctatttttagttttctgagaaacctccaaactgttctccatagtggttatactaatttgcattcccaccaacagtgtacaaggactcccttttctccacatcctttccagcattttgttattgcctgacttttagataaaagcaattttaactgggataagataatatctcattgtagttttgatttgcatttctctgatgatcagtgatattgaacacattttcatttacctgtttgccatttgtatgtcttcttttgagaaatgtctcaaaaccttttggccagattattagttttatttttctctatagtgttgtttgagctccttatatattctggttatcaaccctttgtcagatggatagcttgcaaatattctctccgattctgtgggttgtttcttcactttgttgcttgtttcctttgttgtacagaagctttttaatttgatgtgcttctatttgtgcatttttgctttggttgtctgtgcttgtggggtattactgaaggaatctttgcccagaccaatgtcctggagagtatccccattgttttcttttagtagtttcatagtttgaggtctcagatttaagtctttaactcattttgatttgatttttgtttacggtgagagataagggtctggtttaatttttctctatatagatattcagttttcctaggatttttttttctctttctgcaatgtttgttcttggcacctttgtaaaaattgagttcactatagatgtatagatttgtttttggttctctattttgttttgttggtctatgtgcctgtttttatgccagtaccacactgttttggttactatagctctgtagcataatttgaagtcaagtaacatgattcccctagttttgttctttttggtcagaataattttggtgattctgggtcttttttggttctatataatttttaggattttttatctatttctgtgaaaaacgtcattggcattttttatagggattgcattgaatctgtatctcgctttgggtaatatggatattttaacaatattgattcttccaatccatgaacgtggaatatcttgccctttttgtgtgtgtcctcttcaattttctgcatcaatactttatactgctcattgtagagatctttcacttctttggctaagttagttcctaggtattttattttactcatggctattaaaaatgctattactttcttgatttcttttttggattgttcactgttggtgtctagaaatgctactgattttgtgtgttgattttgtatcctgaaattttactgaatttgtttatcagttctaatagtttttttggtggaatctttagttttttccaaatataagataatattacctgcaaacaggataatttgacttcctttccaatttgaatgccccatcaggactttttaaatggcagagacttataagcaattgatactgcatccaaagaatgacaatctttgtgctcatcctttgcacaataaaatcaagtataggccaaaatctggccaataaggtttctatcagtgtctttccatttcctctaattgtgcctttttgctttgtggaaattaatggaagatgcctctttgaataaaaggaagttcaaaataaaatttactattttgagaagatccagaatgtggactgttttcaagcagatatttgacagttcttaatctggtgggattctaaaaggtcagtaagttggcttcctaccagttattgctggggcaaagggaaccttccttcattctttgattcagaatttcagtctctagaataaacttgagagtagacaggttaataggagaaaaagcatacacatttattatgtacatacacatgaggtcccacagagtgtgagactcaaagaagggcaagatgattgaagcttaaaaagcattttgagctacagaaatagggttttaaagactcttggagggtggtggcaacaagctatgaatgggtgaatggaggaaccacactgcagacaaaggatgtcttattctgcggatagtctcgcaggttgcagccctcagaagaataggtgaaaagtctctctgagcacagtatcctgggcatggagaccttttagtctcctctcctgccacaaagagttagaggatgaggggattaacaacaatctcattcctcctggaggaattttccctagtgaaataagggaacttcagagaaagccccctgaccaccccaaacttcatgagagaaagaggatagtgagatggacagactgggcctggggaatggtgagaagtgaagtgggaggggtcagagagaccttagatctgaggctgcttctttagttaaaagcaccatacttctgggtattgttttctgagcccaaacattattaaatcatattatatttgaatatcacaaatgaaaatcattacatgaattaatcagatcttgatgttcttttaacagtatggcagcacctggagaaaactgtgaaataggtatacttgatttagtctttggctttagaattgcaaggaagaggtgctaagaagtggctatttgatcaccctgcaagctctcctctctgtgttttcctgttcccaggttttctccttctgctttggtctgccagtcctaaagaggaaacacattcacactcaatcaggagtaacttacttccattcactcttccaggagtatttgagcatcaaaatgggactgtgaaaaggaaatgcattatctgaaggaatggatgccaagaccccaccagcaaatgtggaaatttgaggggagtgggttctgtgcacctcgaattcagccacatgtttacccatgctactctacctaaccaatgagctgccctttcttggcaattcagtcttctttcaatatattaagagcagggtgttatcatgtgactcattttttttcgatgtaactttagctgcttgcagaaataaaattgcttcttaatagcagatctaaagagggacaaatcacaagaatgttccagttaaatttatattttctgtaaatatgccaactgcacttgcacttctttttctttcttcttttttcttattttcacattttccctgaaccttctcttactgaaaagaaaataaaaggctataaccatgcacacagatattgctctgttttgaattaggttgctatgttaaccaaaagaaaaaaaaagttaccagctatcattgttccaaaggttgatttctgatttctctaacttctgttgtgtctgcatttctctcctcatttttcaaagaatgaccctcaatagcttaataaatcagctaacaaaatgttttagcatctgctaacattccctcagtgtgttacatgcatgttcaaaggctttgttagaaaacacaatgaagggaaaccacaggcaattctgacaggcaatatgatcgggtttcaaaatacttcaaaaccccaatctttacattaagactttgcttgtaaatatttacattgattgcccagatggtggcagaattggagaatgtggatcactttttttttagaaatgtctcttaataaacttaaagattcataagccacaattgcaaactttagtaaacacagtactacatgttcatgtgaaaagttttgcagctataattattattagttttttaaatcagagcaatgggaagtgaaaagatacaagttttcttcagattttgaggacagcaccttcctgcactatccgtcactaagataagcctgggtcttggttgcttctaaaatagttcaattcaagacaatgaacttgtgttgactaccaacgatgtgaccttcattgtgccaatgatacaaaatcactctaaagtgtagccaggcaaagaattacacagttaaaggagaaaggatgtgactccttctaagtaggtataatcaggatcctcagcagctcttctcttacctggtcagctgcagttatctcctaaaagttcttcttgcttccacttttctttctctctaaaccattctctgaaccacaaatgttccaaatctcaattccatgccactctcttgcttaacacacttcagtgaatccccatcactcccaggacaaagtccaaatcctaaagatggctttcaagacctcccatgaattgtatgtctcttggttacctcagtgaccctgtctctaccacttttgtccccatcctctacttttgggtttagccacacagaactactcatggttacctaaatagggtactctgcttccgtttctatgcaagacattcatccagacgcccttcgcacaagcctgtattctagagggcaggggcgcggggggcatgagaaggcatttagaggaattgttcttgtggcttagcagccattgtgcaaataatgtggattttattagtaggagtggagagaaacaactaggggctaaagccatgtgcaagaggggatgggcaggaaggaccagctctaaggacaagagcatgcaaggcctgcagtgaaaaacctctacgtccttcacgatcccttaaaaatctacctgcaaagcagtcattccatccccctctcctctgcatccccactccaacttggccaacccctaataactttgcttcagaggtcacctctctccagaagactttcccaagtctcaccagcgcttacctccctacccccagggaagggtcccccagaggtctctgctcaaatctggaagggtgtttctcacaggccattataatttgttctttgcttctctgccttctgcaccagactgctcaatttctggaggatagggacagtgccttgtctacctttgtgtccccagagcctggcatgcacactggcacaagataggagctcaaaacctttgtctccccagagtctggcatgcaagctggcacaaaataggagcccaaaacctttgtccaagatattgaataaacatgggatggcgtcagacattcactaagcatgccccagcctctgactcaacccccaggtagagaccactatcctgtcactctcctcatctcccctcaacagatttctaggcttttcttgctcagatttgaaaactaggtagaaaactgtctcactgagacagccaagtaaaaatggctccccagagaacttccgactgacctgagcactgggaggatgggacggggccttgggaagttcctgccagttgcggaggtggggaggagcctggcctctccggttcctgggtggacctgggattcaatcagtgagatgggggcctgtgaacaggaatctttctcgctttgctgagagttttgtttgtttgtttgttttgttttgtttggcccaataaattctgtttttctcacccttctgtgtgtccacgaacctaatctttcctggtcatgtgacaagaacccagtttttagctgaactgaggagaaagtcctaacaacatcagtaggtggcagatgagtgtgaaaagttagtgagtgaaatcagaataatatatattcaagagaggagagaggaagagaaagagaggaagaagctgaggtttgacaagagagaggggagagttttagtttcttttgagttgatttgcttggtttgagaacaggtgttcaagattagtgcaggatttcagaaattgtagcagagaaaaaaagaaatggaaaagaagttgactgttgagacttatgatcttgttgatacccaagaagcatcatttctgaattggaattctttcagattaaagttttatttaaaaatagattgagggccagcgcagtggctcacgcctgtaatcccagaactttgggaggccgaggtgggtggatcatgaggtcaggagttcaagacccagcctggccaagatggtgaaaccctgtctctactaaaaatattttaaaaattagccaggtgtggtcgtgggcgcctgtaatcctagctactcaggaggctgaggcagaggattgcttgaacccgaaaggcagaggttgcagtgggctgagattgcgccactgcactccagcctgggtgacagagcgagactcatctcaaaatacataaataaataaattgaaattcccttccctttttccttactggctttgaactgtgtttatttgtgtgagtacagagatcagactatgagaatcatggactctttcaagagttatgaataaataaatgagttaactaatgaacaaataaatgcatgattgaccttccttccttcagagtcatggctgcagtctccacccatgaactccccacgggaaaaaaaacagtcttctccccagactttggggaatatgaagcagccaaccatgaaaaagttgataacttttctctttctgcaatttgtcttctcaaaagaggaatgccatctgaattagctcccttaacacttcagagccacagcatcttctgaatagctggcacaattttcagcaacattcatttcaaatcctgttgactgaacatgtggttcagatgagagcttattatatattgttaaatgatttcattggattataaatcactgccttcacaattctctgtgggacacacatggaattctggttaaaagatgttcaatattgtaaccctccagagagaggcttcccatgacccttcctcatgcagatgatatggttaagcatgcatggccaggctggcctgcccaacgtggcttggatgaggtttctcttcccgaacttgagcaaggttttcccttagtacttgaccttgtatcatcctctcttggccttcagtccacccattccttagctgtcccttcaccttgctgacccaccatctcgctatggctcccttgcagctgattatgtcttgtccctaactgaaaaatagaaactaaatacattttgaaggaaaatggctaactactgataaatactgctttgccattaggggaattcttgagtaagatgatagtcagcagtgaatagtcagtgaaaagattatcatctcttctgcaaattgtccctggtggagatttgattatatgcttaggggccaccttcctgtcttttagaattttctggagcagctgtcattataattactgaggacctttatgtgaccttgtcatcttgggcaggtagctcctaaagggatttctgaagaagacaattcatattttctgtgcacctgccttctcaatattttttgttttcacttagtgtccctgaaactctttctctcttcacatttcactctctgcatcactaatgaggcttccatttacctctttaattaattaattaattcaatatttatttggcacctattaggccccctgtaggataataacaccttaagctctggtctcatttaggagaatttgcatttatgacaagactctagaagacttaaacttttaaggccccaagaggtaaatttctaatggttggccacccctgagttgggaggcactaatgtggactatgaactggatcatcagcatgtagaaccccagaggcagatttctcctgaagttaataaagctccagcctcggggtctcacactgacacagccttttttttttttttttttggctgtacacaagtgttttcggtcgctttatttataattgccccaagctagaaaaaacccaaatggcttccaacagagcaatagttaaacatccatatgatggaatactacacaacaataaaaaagccaacttttgatacatgcaactacttgtatgaattttgaaggtattatgcagaatgaaagaagcccgtctcatattctatgaagccgttgatataatattaacaaaaagacagaaatataataatggagaacagatgagtgactgccaggggttaggtgttaggggaggatgtgactgtaaagggagttttttgaggttatggaactgttctgcatcctgattatagtggtggttacatgaacctatttgtgtgttaaaattcataaaactgtacaacaaaggacaaaagtcaattttacaatacaataacctaaagataaaattaaaaaaataccttttgggcaaaaatataaattttgggaacggtattagagcttcttagctgcctctgtcatcagttctgtctttggtgcctctcgtgcttgatctttatgtactagaaataccagaatatttatagtaccccaaacacactatgcaatcttgcctccatgttgagccttctgccttcctgatatggaaaactccttttcatccttcaaaaccttactcagagcatgcctcctctgtgcagctattttttctgatttcttctcaccaccagatttaagcacacccttttcggttctacttctgcttcttgtaaattatttcactactgtgtcttacaacttattataatgacataggctagtttttgtaattgtttcttcttttcagtaaattggatctccaaaactgtgtaagcttcaggccccacaaaatctagaccccaaatgaccaatctctctctcaatttgttctagctgctgtaacagaataccataaatgggtggcttatatacaacccagatttctcacagttctggaggttgggaattccaagatcaaagcactagcagatttggcttctggtgagggtacaatcccttgttcatagaaagcatcctcttgccttgtcctcaagtggtagaaagggtgaggcatctgtctggggcctattttagaagggcgctaatcccattcatagaggctccactctcatgacctaattaccttccagaggccctacctcctaataccatcaacttggcgattaagtttcaacctatgaattttgtggggacacaaacattcaggccatagcagacaatctctttccaaaaacagaagatttgtgagatcaaaagccatgtctatcttatttaccagtttccaaaacagcacaggcacatggtaggagcacaagaagcatttgttagatgttgaataagcaattatacgtataatgtgcatagctcttttcctgacatgtagtatgggctcaataaatctttgttaaaagaaggattactttgatgaatgaatgaatatgaagtgaaaggtaggtgaaccctacatttctacacaaggagatgttctctctgccttactcttccctattcatctatggtagcaggcaagctgatttccctaccctaagaccagtgatagtccagcatgggtgaagccatccaggaatagttaaggcaccgtgctacctacacgtggttaataaacaggctcttgttaacaagaaacagttatgtggaaatacttcatttccatctgtaaagttctagatttcaaagtggagagctgggatctcttcccacttcacccactcctaacatttataataaagcattgcctaacacagaattatatttttagagaaaaatgaaacacatgcttgagaactcaatcctattaacacaattttttcagtagtggtaaccattaaacagttatgtatttaacctttgtattctttaagtctgctaaaatgtctaattagttaatcaggaaaataattatttgctaaaaaagggaaatttgaaaattgtgtacagatgcataaaactgagttcaaaataaacttctattttgaggctttagtgcaatcccaatgtattagcattttatgattctttgtattcattaaaatgtttttcacaaaaatattggaaagtttcccaaagtcctcctcatgttcctcctggtgtatatcaaacagaatattggactcatctactcaaatcatagttagaattgtattttgtaagaggctatttccttggaagttattcaaaagatacatgtagggaaatattctgatttataaggtcaatctttctctgtcacaaatcaattataagtaaactgttttcagaactgtcttttttgctatttataatagtcaacttgtgaagcacttaacacacagaaatgtgtctgacaccaagattattgttaagggctgttctttcctttttattcagcattgtacgcatgtaccatttacatttattacgtggataatgggaattcatggtcttgaaggcatagagtgaagaaattacttctgaatacagtatgcaagctgaaaagtagggagtgatcatttcaaggttatagtgagggcaactaattttttccaatttggggagtaaaacaattttataatgcatttccaaataaagtctattttatatggaatagtctacagttgccaatcaacctgcccatccaatgcccctttccattggctcccactatcctaatcctaattagtctcgacttgtcctggtgcttttggcaggaagaattacgtttgctcatgctgttcccttgaccatgacatctcttaaaggcaattcactatattgtctgagattctaaaaattaaacttccctactgggatgggtaatactgagtgtcaacttgattggattgaaggatacaaggtattgatcccaggtgtgtctatgaggatgttgccaaaagagattaacatttgagtcagtgggctggggaaggcagatccacccttaatctgatgggcacaatctaatcagctgccaacgaatataaaacaggcagaaaaaggtaaaaaggagagactggccaagcctccgagcctacatatttttcctgtgctggatacttcctgccctcaaacattggactccaatttttcagtttggtgactcggactggctctccttgctccttggcttacagacagcctactgtgggaccttgtgagcatgtttaatacttactaaactcccctccatatatatatatatatatgaaggatatatacatatatgttctgtccctctagagaaccctgactaatacacctacccaagctaatgctttctctacaatgaattgcaaagaaaatgaaagctaacaaagaagatgagtttggctttttaagaaaacagttgaccagacataaaagatctcagggtgaggaaaaggcagttttcttctgaaggcctacagatggaagggacagtatgggtagctaaggtgactgaattcccctctgcacttagtgtgtctggatacaattattggctctggcaatttgggtgctgtgctttcaggacatagtgtatggtgaatggtgggagaattcaaatcatagactctgacaaaaagtatgctccaattctgtttccccatctaataactacaactgtggacaatgtatttcattaccctgagctttggtttctttatctgtgaactggaaatactaatacctacctggccaggttgtcaggattgaagatagtatataccaagtacttatcacagtggtttgttagcaaataagcactaaacaacagtagctattattgtaatgacgactacatggtccttatccttctattcagggtgaggtgagctaagatagttctaagagtttaatgaagcagcattgcctcatgactggtaagaataagaagacatggggaaaggtgtttatcatttaaggaactaaggtgaacagaatcaaaaaggggttgtattgtatcttaggaaactaagataagactggaatacagccatcaggatctatttgtaataggatgagagctcagttgcaaatacaagttccattcatttgatgaaagagtctggcctgactgaggctgtgttttgaactcattacagttagactcctgtggctcaatacccatttgtgctggggctgtattgttcttcatttcaacagacatatgcaaatggttctgagaaatgttagagcctgttcttctaaagtgaagttagtctttctcctggttcttactctagaaacaataacattgttgggtgccccctgtctttcacctcacatctatttcatccccaactaatgtcagtggtgctaccagtgcgacagtagactaacgtcctctggtaggaaggactcaactattctaacactcttccacatttctcttaagttgtgctggaagcagaagtgattgagtttcattcattcagtaggtattcaacgcctaccatgtgttaggtgctctcctttgtgctgaggtaaaataagtaaagcagacaccgtccttgacttcattgagctcagggactgagaaagatgaacactaatcaaataatcacagaaataaaaaattttaatggcacattgtgataattgaaacagaggacaaattgagaatgttctgagtttttaaggggcctctgacctatcctggaagtttgaggaaaggcttcctggaagaagtaccactggagatgaggtgtggagctataagtgggcctataggagtggggtggcgaggcgtgaggcatattctaggcagtgtgggacaaagtccttagacaagaagcagcccagggtatccaataattgaaaaaggaggctggggtgactgggggtgggggaggtgctaaagggtgaagaattaggctagatgatcccatagggaacttgtaaaagttaactatgcccagacccactcctagacattctgctttaattggcatgggatgggtccatggcattgccatattttatttaaaaaccaaactaaaccacaaacacacaaacaacaacaaaaacaaacaaacaaacaaaaacaacctcccaggtcattttaacatacagtcaaagctgagaaattctgaggtacaacatgcagcaccttgtagccatagttttcatcctaacaacaatggggagtcctttgaagattttaaggaggggggtaattagtattaacattatcagatttgcttttgagaagagccctctggctgaaatatggcaatggatatccatggcatctaacaaatcttgctgtgcacccggtaaacatatagtggtagactcaaagtagactgggcatcaaatttactgcatgtgaagactctagatcaaaatgcaacttggtggtgatagatcctcctctgttgaataagcggatcatttcattcaagactgtaatttctaggtggaatgcaagcacagactttcaaggaagcttgaaattcctgacttggtttgggtccatttagagagatttacaaagagaagaagcgatatttagggcacaaagctatatctggcacaggtgacttgtgttagacctggagactcaggcctgtctcttagcattgaaggttcctgagctcccagcaggccatgtgtggctcccaaatctccagtgggaaatatggaaacactttgaactcccttcactatcactgaaggaaacagaacccgatttcagcatggatattgatttttaaaatgcacttcaaatgcacagaaacttgtagtgggaatgcaaggagaaagcagggcatcctgagaaccatgttacatttaggtcattaatcaatacgggatcagaaattgaggaggtgggtgttacaaaacttttcttaatagaatatcatatatgtgacgtaaaaagtcaattaaaaatctcattgatgaggctggttgcggtagctcatgcctgtagtcccagcactttgggaggccgaggcgggcggatcacaaggtcaggagatcgagaccatcctggctaacacggtgaaaccccatctctactaaaaatacaagaaattagctgggcatggtggcaggcgcctgtagtcccggctactcgggaggctgaggtaggagaagggcgtgaacccgggaggcggagcttgcagtgagccgagattgtgccactgcactctggcctgggcgacagagagagactccctctcaaaaaaataaaaaaataaaaaaatctcattgatcacctttgctaagaactaacttaactagttatttgaaaacttttacaaaatattaattatgtttccaaatgaccaagattgaaaaacaggaaagatgagtaagtcttaccataaagttatcaggaggctacacaaaaactaacaagtaattacacgaaaatacggggccctttcttctctcaacttcgcagtttcactcttcctggtctctcacctactctctatggtgtattttcagtataaatcaaatataattatctaaaaagaatgaaagcatatatatttcaaaatagttcacagaaaataaaagatagcagatgagaatagagggagaaagatgtggaagagaagaggtgatggaagacaaaactttgccagaagagacaaaagaactttaaagtctaatttataaattgctaatctgaacaaactaatagtctttcaatgcactcagtgattggcgtaatttatcttggctttaacaaacatgctgatattgcttcttgtaacacatttattaccagaagaaaaatataattggtatcagtgtgaatgcctttggctgcaagtaacatcccaagtcagctagcttcaacgttaagcaaaatttgttacctcaaagagcaaggaatcttgagatggggtggctttgacaacttccgtatttcctccctgccattttcaaccagttagatttgcccctggcaaccatcccatcatggttgcaagatggctgccatagttcctatcatcttaagacactgtaatatctactggtagaagacatacagtttcttcctatatgattcattataaaaagcaagaaatcctttccccaaggtcctcagcagacctctctgatgtctcattgtgaaaaacttgatcaaaagccgacctgcctgtgatccatttaccagcaaaataaataagatctctctgattgaaggattggtgctgatgaatgaggttttaaccttgaataatgtaggggatgggtgaaccaacagagttcttctgggtagcaagaaagattgaatatttcttaaataggttgctataacctgcaccagtgtttctcaaacttaatgtttggaatcacctgtgatcttgtgaaaatacagattctggttcagaagttctaggctggggcctgagatcctgcatttctaacaagctctctggtgattctgatgctgctggtccacagacaacactttggatagaggatctagaccctagacaatcagatgagaagcagtctagtataatatgattgaatacagcttatattagactgtctagctgggtgatttggggtatgttacttaaattatctaagcctcagaaaaaggaaggaattggggaagaagaaagaaagggagagagggaggagaaaagaggtgtgtgtggggaggtgagtcgcagactcattgatgagaatctccaaagcagtggtgtttctgttcgcttttctaattcattaagatccctctgtggtgatgaattagagaacttggaagaaaataaacagcgtagtgtttaatatgagcattcaggaagaaaataaataaactatactaataaaattctgggaatggtaacaaatgtatatgtatagcagaataaaaaacctcagggtcccagtgatagcaaggtatattgaaatactgcagtgatgttacagttacaaaacatactctgcctttctgatgcctaacaatgcatatattatgttctgagctatggagttctgaaggataaagctttttgcccctgagtcatacccagaaaggaactgtggcagacttagggataggttatgaggaaggagtaaaggaagaggaatcctcattatgaaataagaccaaatgacacacctaacccaacttcagggggagataggtccttacttgacagggagaggcaaatggctgtttcctgtcttgacagatcagatagaaaagtgaacaggatgcagtagcagaatgagggtatgtggaaagatttgagcaggacccctgagtctagatccctcccagtcctgcttttcactagccctgagtcgttgggaagttggcttaacttatcctagtctcaggtgtcttccaagagctactgaaatagtaatagaagtcaacgtacacatgataaaacaggtagcaatggagatccattatctcacctactacctccctgataatcccataatattggcatcatgattatgtgttattaactctctggggaggggtggtgttctataaacacatatgatttcgcttactctccgtaccaagtctactgactcctttctgccttcaatagcaatattataatagcagaagaacactttgcatcagttattttgttggtcttcattaggcattaaattcagtcaaatgaagtagtgattttgattccaaaacacttagtgtgacagtccttacctctgaccttgttttgcatgtgtcacagtgttttgtaaacttttcctgaatgtgaaatggatgcctcgcgtgccctgctttcgccttgcagtctgactattccatttctgtgcacttgaagtgcattcaaaataggcaatatctgtgctgaaatagagttctgtttcttcaatgataataaaaaagaatgtcagttttttgcttaaaacccacaacaggtagttagtggaaacttgaaggtacgagttatgagcgactttaaaatatattttcttctgtgttgttaatggcttacatatggggcttcttgcagggtgtaggaaacttctaaatagtcctaggagacacacatgaacaaaaaggtcatggcattttgaaccctcactgctgccttctttacaattacccatatgacctttggagaggcatctcggagaacaccagggatttgcaggaaagccgggctgcttggcctggctactttctacagaagccatgactgctaaaatggactctcagtcatccccaggctgagaagttagggctgcagcttgatttcaaagaatgcagatctaaggtccaaggtgcaattcattgtccacacatcaattaataatgcaataccagactccaagaatacaagacagcagtgtttttcaaatataataacttgaggaagttggtgagaaattgatacaaaaaagtaaaatatgagttcatatagcaattcccaatcatgataatacttctactgggatatatccatttgaatttactgagaaccttcttatattggggtagtttagaattagttctatctacaaatagtaattcataatgactgtggtattggtgaagatgatgataatggtaagtggtaacatcttttaagcatctaccgtatgccagaccctatgctaagggctttgtaggtatcatcttatttaacccagtgcaaaaaaattgacaaattctaggcttaggatcaacatgaggataataaaattttcttttggtaattacatctaaggacataagtacaattcacaaaccttgaggtcaaggacttcacctttcatcttttgatggtgctgcacagtgcctagcagagaaaagactccacaaatatttgttgaaatgaaagaagcaaggaggaaagttttcaaagcccagaaatctgaattatatttgtaaaactaactcagtttaataaaatgtgtcagtgttaactacatcatttaaatgattattactttattttctaaatttttataacaaggagtttaacaatgctgccttagggaaataacagcacaaatgcataaagatggttgggtaagaatatttgtttcagcactgcgtggtacagcaaacataaaacagagccatttaaatgtgtgaatagagaggcaaaaagaaaacaaggatgcaaacttttttttttattttatataattaaaagattaaatgttggggtaatagtcacagactaaatatcttatattcattctgcagacatctcagttaagcatttggaattatgcatgattttttatttatttccctttttctgtaattttaataccacaaatctttttgcaaaatgaagagtccatatttttgctacagaaaccaggagatcagagttgccaatgtggaattatggacattggtgtgtctttctgaagagaaatctaaggctgctacgtgtaccagctgggatcctttcacattaggataattttaatggtagagcacttggcacaagttatttccttggtcttcattaggcataaaattcagccaagttaactactgatgcttatcccaaaacactttcactctaagacttcttaccttggaccttgttttcaaatatatcccattcagatttttcctaaatatctcccatccaagtactaatcagggcagaccttgcttagcttccaagattagatgagactgggcacatttagggtggcatggcctctgtattagtctgttctcatgctgctataaagcaatacctaagactgggtaattgataaaggaaagaggtttaattaactcatagttttgcattgctagggaggcctcagaaaacttacaatcatggcagaaggcacaggagaagtaggcactttcttcacagggtggcaggacagagtgagtgcaagcaagagaaacactagacgcttataaaactgtcagatcttgtgagaactcactcactatcacaagaacagtgtgggggaactgccaccatgatccaattacctccacttggtcccccacttgacatgtagggattgtaggtattacaactttgggtgagatttgggtggggacaaagagccaaaccatattattctgcccctggcagaatctcatgtcttttcacatttcaaaaccaatcatatcttcccaacagtcccccaaagtctcaactaatttcagcattaactcaaaaatccacagtttaaagtctcatctgagacaaggcaagtcccttctgcctatgagcctgtaaaatcaaaagcaagttagttacttcctagatacaatgggggtacaggcattggataaatgcacccattccaaatgggagaaattggccaaaacaaagaggctacaggctccatgcaagtctgaaatccaatagagccctcattaaacctcaaagttccaaaattatctcctttaactccatgtctcacacccaggtcatgctgatgcaagaggtgggctcccaaggccttgggcagctacagccctatgcctttgcagggtacagcgtcccacccagctgctttcatgggctggcgttgagtgtctgtggcttctccaggcccacagtgcaagctgtcagtggatctaccattctggggtctggagaatggtggtcctcttctcacagctccattagacagtgccccagtggggactctggagactctaaccccacatttcccttccatactgccctaacagaggatctccatgagggctctacccctgcagcagatttctgcctggacatccaggcatttccatacaccctgtgaaatctaggcagaggttcccaaactcaattcttgacttttatgtacctgcaggcccaacaccatgtgtaagcttccaaccaaggcttggggcttgcaccctctgaaacaatggcctgagctgtacattggccccttttagccatggctgggactcaaggcaccaagtccaaagattgcacaaagcagcaaggccctgggcccagcccatgaaaccatgttttcctcctaggcctctgtgttgtttgtgatgggaggggctgctgtgacaacctctgacatgttctggagacgttttccccattgtcttggtgattaacatttggctcctcgttacttatgcaaatttctgcagccaacttgaatttcttttcagaaaataggtttctcttttttatcgtattgtcaggctgcaaatttttctaacttttatgctctgcttccctgtaaacataagttccaattccaaaccacatctttgtgaatgcataaaactgaatgcttttaagagcacccaagtcatatcttcaatgctttgttggttagaaatttcttctgccagattccctaactcatttctctcaagatcaaaattccagaaatttctggggcagaggcaaaatgcagccagtctctttgctaaagcatagcaagaatcacctttattccaattcccaaaaagttactcatttccacctcagcctggacttcattgtccatatcactatcaactttttggtcaaaacccattcaacaagtctctaggaagtttcaaactttcccacatcttcctgtcttcttctgagccctccaaactattccaacctctgcctgttacccagttccaaaggtgcttccacattctgggtatctttattagcagtgccccactctcagtaccaattaactgtatcagtcctttcttatgccgctatgaagaaatacctaaaactgggtaatttataaaggaaagaggtttaattgactcacagttctgcattgttgggaggcctcaggaaacttacaatcatggtagcaaagaagaagcagacaccttcttcacagggcagcaggacgaaataagtgcaagcaggagaaatgccagacacttataaaataatcagatctcatgagaactcactcactatcacaagaacagaatgggggaactgcccatatgatccaactacctccccttggtactgcttttgacacattgggattatggggattacatttgagatgagatttgggtggggacacagagccaaaccatatcagccccagaccctaattaatcttgaacctgaaataattttagtgttgcctctctaaccatttgtgacaaagaatgagtttggtaagacttagttcaaactttaagttaacagatattctttatagaagagaaaaggctctagctgcctctcttagaaaaatacatatcaaggccaggcacagtggctcacatctgtaatccctgccctttgggaggccgaggtgagtggatcacctgaggtcaggagttcaagaccagcctggccaacatggtgaaactccatctctactaaaaacaaaaaattagctgggcatggtggcaggtgcctgtaatcccagctactcaagaggctgaggcaggggaattgcttgaacctgggaggcagaggttgcagtgagccgagttcacgccattgcactccagcctgggcaacaagagtgaaactctgtctcaaaacaaacaaacaaaaaacaaacaaaaacaaaaaagaaaaagaaaaagaaaaatacatatcaaaaataattataaaaattacttcattgctttacttgtttttctgtacacaacccagtgagttctcttccaacattttatcatggaaaatgccaactatgtgcacaagtagaaacaataggataataaactcccatatacccattatatagcttcaacaatggtcatctcctttcctaaatggctttatctgtaccctatcccttattttcccagtccctggattattctgaagcaattctcagtatatcatttgacctgtaaatatcaccgtatatatatttctaaaatatagaatagtttaaaaataatactaatacaacactgaaaatttaatattaaatttcttttccttgatataataagttattattcatttttaaattgtaacttttttacatagtttgtttgaatcaagatatcttgtgccttttttaatctgtaggtttctgtctgtgctttctctcattctccagcctccctccctgtatcatcgctatgattgctgtttatttattgaataaatcagattgttttcctgccaaatttcctctatctagatttagggattaaatatctcgtctgtccatttagagtcagctcattgtattcctgtattgtcattgaatatgttcccttttttcttgtatttttcctaaattaatagttttgtagctaatggactaatcacatcaattcaggtgaggtttaaattttttgtgtgggggaggtggggagtttgtttccataggtaaaagtgttcttctgtgaggaaaatacatgaaatctatttttctctctttctgtgatatttgcagtctttgataatgtcatcttttcccctgtgtatttttgggtctgggatgaaattttgtctttggctacattacctgtctagggattatcagagtcctggccccttcattttgctgagaaaattttgcgagttgcctatgaaatgtatgctgtaggtaacccagtagttactccgatagaacgaagtaaggagataagtggaaagtgagttaataattctaccactggctgtatacccttgcctaggttaagccccatgactgccattttcatcatctgtaaaatgggaataactatacctatggtttttatatacaaacatatatggcacaaaaacaatgtttaataaatgatagttattttgttgctatttaaataatagtactttgataatgatatcttgatgaaataataatatagtttagtctgtcatattttaacactggtttgctgacggcagcaggtttggtccatttcttctatttttatgactaatgttaagaaaataatattacaaaacttggaaataggtaaaagaatgactacaagttctttcaatgtcacactggagtattagttaacagtcctgcccaatgataatttcattttctctggatagctattttactattttcctttggtttagatattttatatttctctaaaggtaaagactggattgcagaaaattaacagtcacataaataattttgtctaatagaaatgtaagtgaagtttgtctggtagaagagataacctcaaaggttattgtttaattatccattagagcaaaagctagttttttatctatcttagctatctacttccacatttccttagagccaatgcaaactcagtctctcaaattttctttgaactagctttatcatcgtgctagttctatcagtgagttaaatcaatcttggacacatgcaatttatattcgtatgacagcaatgtatttaaatttttgaaaatcgtacttcaatatgaagttttcaatctcattggtgaattttgctggtctgtttgatattaattatagattctaactacgctgttgccatttctctagaactcatgggagggtacatattaaacctcattaacacatcatgagctagaacctgtactggttttaggtatgtagccaaagactaaatatccttattaatatcaaataacttttatttcgatgtatggcagtggtcatgcattatgatgttttgaatttgtcaatatattctgtttagaaaaacagaagttcctactatgaaagttagctttctttggctctttatttttaaagtgctttaaggtgtagatttccattttttgggggggttgcatttattcatacatatgtggcaattctaaatgattaatcaaaaagtatcataaattattttttcattcctccaaagactatcctgtaatttccagcccaatacctaccccatctccacctctttcacctgagtaaaggaaggagtctttcttgcttggaaaaaaaaatgtaaaattcaactatattttaaaatgctgagagagaaaggggtggggaaacagatggaggcaagaaattcatcagagttgaggaaggcgaagaagagaaattttgtagggtttttgagaggagattatatgagtgttgtggattgaaaagaaaaagaaaatttaataaaatcagtgagtaatgtgttggatctttaaatatcttcgagaagcttgggtatagaatgaaattaccatgaaattagtttataaatatggtttgaccctaaaccatgcttcttgaataaggaagtacttgggaactaacaacatgattctccaggtttatcatatcatgtctttagtctgaaaatatttattgaatactaatgatgcactaggctctcttctaaagtctggggacatacacaaagacagagagcctgcccttggggaacttacattctcactggaggtggggaggagaacagagaataaacaaagggataaagataagatatgttttatatgccaggtggagacgagggctacaaagatataacacagggtgagcaggctggagagagagaagtgggttctgttttatatagtggggtgaagtaaggtcgccatttagtaaatagcacatttatttctagccaagaagacacagttcatcagattgagatcatctaagtagacatcagattgagtaaaagtttcttagatctggattctggtggcccagagtactgaatctgcagtatttcacatccctcagaagctagtgctgctattatatttttcttggtaaatttgtagaacccagaattattttgaggggtaggcatgggttggagatacatattagagaagagagaactagagtgaactctccctaaaatcactttttatttagaaaaaaaaagagacgctacactgcatttccctagtcaaggtttgtacagttccatgccatattcctacaacatgtttgctcatcagagaaatgaaatgtgaagcagttctcttgtatcagtttagagctcctttgtcaagggagggttattttccataaattcaatgtaaaaggaaggaaacataattcactttcaaggtcattaaaagaataagaaaagttagatcctatcaataaaactttaatatgctaaactaactggcagcaagaaagagagctattttctcaataaatattgtatacatgtgctttgtcaattaactttttttgactgtgaacaaaatgtaaatgtcatggataaatgatagctttaatgatgtttttcagcgttgtactgcctgttaccacggcttcttaacaaagatgttaaatcattaggagtcatatttcatgataattaactacaaatctggtaatattaccacttttcatttggcatgaaatgacgagggagaaccatgaggtttattggaggtacatgacaaaggacagagagacttaatgtatgtgtataaatcttataaaactacctattggacagcattttatgatggacataaattcccattcactctctgctagtgatagacagggaagtctgcagtggaagcagaaagctgagatgggaagtcaccctagagaataaagggggcgtatgggtttatttctttgtcttacttgctcgctcttgcaacagctaaacagatcctcattctcgcctaagttttgaacaattagagtatgcactgttattaattctcttattaaatgtattttattataaagtttgcaaagatgcttttatgattaaggagctattggcatttgccattttacactactaatcttccatctgcttttctttgaaccttttaaaatgttcagcaaggtcactcaagattttattgtagggaaataaaagatcaggaacactctgccttgttaatattttcattccagcctgttgttaatatagagagatagtgatatagggcggaaaggacacttcttatagagttaggtaacctgatttgattttgcttattttgttaattttgatattgaccactgtatcagtcaaggctttttctgttgcaagtgactgaaatccaatgcaaagtagctttagaaaaggagaagacactatgttggttgacatagttgaaattttgaagaattctggcacagctctcaagaacaaatcgccccaacagggccatctgtaccaggctctccatgcctctgctttgctttccttggtgcaagcttcattttcaggcaggctgtctccatggtgagcagaacggcagttccagactcattaatcttgatgcctagagatcccagaagaagactgcagtggctaattttaggtctcaaattgactggactaagggatacccacctaattggtagaacgttatttctaggtatatctttgagagtgtttccaggagagactggcatttgaatcagtagattgagtaagaaagatccacccttattaagtgtgggcagttaccatctaattggtcgaaggcttagatagaacaaaaaggcagaagaaaggtgaatttgctcctttttctcttccggaactaggatcccgttttctcctgtccttgcacattggaactctgggttctctggtcttcggactctggaacttgcaccagcagtctgcctgattctcaggcctttggatttgtactgagtcatgctactgacttccctggttctctagcttgcagaaagcttatggtgggacttttaagcctccataatcaagtgggacaattcctcttataaatctcctctctgtctctctatatgtctgtctgtctgtctatctatctatctatctatctatctatctatctatctatctcctctccatcctattggttctgtttttctggagaaccctgatacaaagactgtttctgacactattgaccaatatccacatcaagggtctggttggtccaactgttcaccttagagttcatctatgaagctaggaagagagaacatcatgctttgattgtccaggcctgagcctgtgcctgcccgcctcacccatgggatggatgctaatcacatggtcttaaaagaattaatatgaagtggaagaggagtggttatctgaagaaggaaatgtcaagcagtcaagtagcatggatccactgcttggcattcattcactcatttttttctaactaacttttaaaaattatttaaaatgtttagtcctccttcaagcattgtgctggtagtgacacaaggatttagaaagggagaacgagcttctaggaatttaaattttagagggaaatagttatgtaagaaacatatataatgcaatgagataaagtattcaaagtcaatgatatattaaaggaaggatcttatgggtttgcttgttagagtcagggaaaccttcaaagaacaaacttaaactgttgtttgatttcctctatgagaaccgggtgcacatcggggctagagtggttcgcacttcaggatgaaacaaccgtgaagaacaaggaagtggcaggagatggagctaaacaggtcatcagaggtagatcttgaaaagcccttcatgtgatcaaatgaaattttattattttttctttctgtgagattggtgatattgatcagatgaataatatatatcaaatgtgtacactaaaaagagcacttttatgggcatgtagaggatcatttgaaagagtaacctccccagcctcagaggactttctggctcactcactcagcaaatattcattgagtgcctgctgtgtactgggtactgtgtgagtcaaaatgtaaggcaatgacaatggaggtagaaaaggagacaaatgtgaaagcaatttcacaaagagtaacacatttgatgtcaaatagctatggtagggaagacacaagactttctggttttccagtctgagctattgggaggaggcaataacattccctgagccagggattctctgaatctgtttactcatacataacatgacaacaataacaagaagccagaatcacaggactattatgagaatgaaatgaaataatacaaatttaaaaggattttgtaagctttgaaacataaaatgagggtaaggtgttattttaaaatatatgtaacatatttaaaaataatctctggttgcttttgattccatgatgatgtaattttctccccataagaagtatctattgggcagaataaattaaacaaaatggctttgctatctaactaaaataagcattatttatctcaaaatgccagtctttaccagcctcactttctatattctggcttttttcccattatgcagagtgttgatttggaggggggagtaaaagccagttgagtttctcataaagtttcacactgcagacttgggcgacagtggttttgtttaaagctgattcattgggatttcctaagagatgctattgtataggtacaataactgtttagtgaggttctttatgagacactcaggattatggatccataatttgcattcattgcaaacattgtaacaacttcttttgagccattaaaatgaaggtattgaaaggctgttaagaactccaccaagccgtgaaatcacaacaggttcatttattggagaaaatatcattaagatacaagccagcattacaaatccagatctcttctacgcagttgtcacatttaacttttttccagcctctctgggcaaaggaaggagctgttatttgagtaagttggggccctgaaatcattttgcaatgcacccatccaggcagccatccattcatccactcattcatttcaattcctaggtgctggggcagacgctgaagaaaataacatgctattcctacagagcttaattgtagagacagacacataaaatatatttgcaataaaatgaaaacatgaaatgataggctaagtgtggggtgctttggatgctgctgagaagacagggcggtaggagaaagaagcaattgctgaaacaaaaagaaaaagaaaggctgttccaggcagccaaattaataaatgagcattgtgttgcaaatttgtgaattctgctccctgggaatcagtaattctatcagctagccttttcacttccattttcagaatttctgatttaaagacaaattaagctaaatgcttagttgctccataaggagtctgatgtgaaaaacccatctatgccatcactgggggttctcattgtttctcatctgtaaagtcttttgggatttagatggatcagctggctgacctttgctgctgtcctatgagacataaagataatattcctcatatacctaaatcatctagcagaaaacctgagacacagtaggcccacaataaacagcagatattatccattgacagaatggtggcttggcaaagtattttaaattgaaaagaagaaatatgaattgcattcccaattcctttaaataattgcattttcttccatcttgtaattaaggtctcatctgaattttgccccatacctataagacattaacaacatagattcatttaaacaaattaaaaataatttcaaatttatttttaacaaatggttagactgtcttttgcaggtgcacaggaaatgaagtattattattagtttaaagaaaaatcatgacagtttcatgactaaaaaagggaaaaaattgtggaggacacagctgcacctgatatatatcaataattagttcctaatctcatgtgtttgtaacatataaatcatctttgtttccaaaaataagagcatagtagaatatctatgaattaaaaatgactagttttattactactactaataaccaatgcattgtaatccaaataaagctatctttgggttgtaaataagcaaacagaatcacaggaaggtacaaaacatccctgtgattgttgcattaagtaccaggtctcttaagtctaaatagattgtctcttgttttttcttctctttgttttgttgttgctttgttttttgtttttagagatagaggtctcgctttgctgcccaggctgaactcggactcctgggctcaagtgatcctcccatctcagcctcctgaatagctgggactacaggtgtgagccaccatccctggccttttgtcatatttcaattgaaataatctgggctagttttacaatagaggtaaaaaattccaactctggtgctttggaattgtataactgtaaacaagctaattaacttatctaatctataaaaaaaagggatgatattaatggccactcatgcagttactgtgagaataaataaaggtccagcatatgacccagtctggaggaggtatttagtaaaaaattgttgcacctatctttttcttagcttatcactcaccccgtattagcttttgcaatgctttccaatttgtaacaacccatggggattatgggagctacaattcaagatgagattttggtggggacacagccaaaccctataacaaagtacactcctgatttggaatatgtaacaattcaaatgcataataaaagaaacgtggctcagagtcgaagtgctgacttctaattcatgatgaaaatgctaactgccttatgaccttaggctagtcacttagccctggggcctctagctatacaattagctacagttaaaaaatgctacatcattattataaagtatggtaagtaactgaaataatggatgttacttaaaacgttatactaatttatataatgactgttttttcttggtttaatgcttccattcaactgtattttttttcatttcctacttctttattactgttagtggaagattttctttgccttgtttatgaattttaatctcatcaaattcttaacatcaggtttggaagggaacttgcatattatctgatggagtgaggtccctgaggtgctatttcctgcttccataccatggtagatgtcatttgaatctctttagtgacagagaactcactgcttcttgaagcagtgtgttcctgtgtttgagaagtactgctatgagattctttctaacaccaatccatttctcagctacttcttgccaaaattctacctttaagggctacatagaataagtcgataatccctgccacatggcatctcttcagaaatttgaaaatgggtaacatacgtattcctagactctatttattcgtcatatgcaatgatttaggtatttcagaagtatccattttacccaagatttataattagtatggtattataacacactgccatatctttgaatgaattaagttttagaatattgcgttattcatatatctatatgcactgcttaaatatagagtttttctattttttctaaagttacaggaaccttatgttccaatccatatataacatcagcacttcggacacttctgctgaatataggaaaaaaatcttcaatccaaaacaactaaacaaaaaaagaacatgttgaagcttgctaggtcaacgttcaaagcagaaaaagtttgcatgattgtgcctgagggcacatgaaatggaaataactatttcctaatcaataagtgtgatcatacctggaggtgaggtcaggggaatagggagcaggtatccagggccctgtctaaaggacaccttgtaggccccagggaaagagaccaaacctctgatgcaaagaaaacaacatggaggccaagagggccaaatctgtctatagatgtactgtttgcatggcacaatgttacaaaaaatacaggaggctgcttttaaaaatcaggagatttggccaggcgcagtggctcatgcctgtaatcccagcactttgggaggccgaggcagatggatcacctgaggtcaggagttcaagaccagcctggccaacatggtgaaactccatctcaaataaaaatacaaaaaaattagctgggcgtggtgatgggcacctgtaaccccagctacttcgggaggctgaggcaggagaattgcttgaacacaggaggtggaggttgcagtgagccgagatcaggccattgcactccagcctgggtgacaagagcaaaactctgtctaaaaaaaaaaaaaaaaaaaaattcaggagtttttatataaactctagattgcaacttctcttgaagacttggaagtcctggcaatattgggcctgcatttccactaatcaagcatcggatgataaagctgatgggatgggacatctccaggtgacctctttcccaccttttcctatgtgtaatgtactgaacccactgccaccatctttattgtttgcctgattcctgtgggcattcaaacccccagttattaggtacctggggctatgcctgcctttattatttcagccacatccttctttcttctaaacctcccgttttctttaattatttactcaacccaagatagcacatgtatgtgcaagctttctcaagtgtaattcttcagacaacacagggtggcttggtgctcagatctcctcctctgacaaatgttgagacttctccccttcaccttttcacctgtaatccagtgggtctccagtattttttcctgccatgctgcctgataaatggtattctcctgtgggctacattctcacttttaacaatgctcacttgggctgccacaaggccaaaaggagctgcagctatgtgcccagatgtaacctttgtctcttccttcccccaactgtgtggaattgacgttcttggtttttagtgacagaaaaccagaagccagttaaaatatctttacctggcctataaacccattaaaaaacaaacaaagaaacaaaacaaaacaaaaacactctctttaggcatcagggagaggcaaattaaaaccatggtgagaagtttctagacatcggattgcttattgtattactctttgtaactttgtgatatggtttggctgtgtccccactgaaatctcatcttgaattatagctcccataatccccacatgttgtgggagggacccagtgggaggtaattgaatcatgggggcaaattttcccatgctgtttcatggtagtgaataagtcttatgagatctgatggtttcagaaagggcagttcccctgcacattctctcttgcctgctgccatgtgagacatgcctttgctcttccttcaccttctgctataattgtgagtcctccccagtcatgtggaactgtgagaccattaaacctctttttctttagaaatctcccagtctcgggtatttcttcatatcaatatgaaaatagactaatacactttgactatctaatatagttcctaataacaaaaattggaaaaaggaaaaacacaattcttcctgcctttcctttcttgctaagtgcacagtctgttgagatgagaaagagaatgtgttgatgtggctttgaaaaagaggtgctgggtctggtaaccaaagactagatggagggaagtttctgtgtataagtgaaatagcgatgatagaatgccattttgcaaacctaattaattcaaggatctatgcaatacttatcaatgtctgtcatcacacacacacacacacacacacacacacacacatgcacacaccccagaccttaagtgtgtcttatacatcatcacttataaagtactttagccaccactcacaccccccaactcaccaatcctccagacataattgtggagtcctaataaggaaaaagaagtcaggctggtgggaccaggggaaagtataaagaaagagcagataagctacaagcctgcctttcttcatggtccaggacatgcagccctcctgtacagatagctcataatcttcctgcacctgacttatcacgagaccctcggctaatagaaaaatgcaagttagctcactgccacattggcattatcaatactgcatgtagccctctccagcatgagcacaatcctataaaatccccagcaagcttttgtctcctggcagtcagctcctctcttgatgatctgcctgttgcacccttgcaacatattttcatactttctctaataaatgtgccttttgttacctacaactgtcttggtaaatttctttaccacctacaccaccagccccagttagccgctacccacaacaataactattgattaggaagtgcagagaagagaggaacatgttaaattataccatagagccagcaaaattcctactggaaaattctacagatcaaatgacccagctttttcaacataaaaattagaagagagggggatagaaagagagagacagaaaaagaatctatttaaaatatgacttaaaagacatccacctgaagcaaatgtaacaaaatgatcacttattaattctgtttgatgactacaagggtattacacagaattgttctccatacttctgtagcttagttttcataattatatgatgtttctgtggtcaaaaacaaacataaagaccaaatttggttcaaaaaataacagagagagggaagtgagtagaggcatacatggcattttaattttgtgtatattggaaatactccatattaaaatttgaaaaacaaacagaagcagagatgccaatctcccccactgcactctcacatacctgactgctagagggtaatgttctgtcctaataagactgtatctacccagtctggaaaggaatttggttgtttctgatccctaagaagaatatctcatttgcctttttctatggtgttatcagaaaatgctttgcagcaaataaatggcaactccataagtggatgttaatgaaattttaatgaatctgaggtgctggcaccatatattcctgcagagctcagttttttaaaaatgctgctttaatgctgaaagtttacagaagaaaacagcaacattaaggccaaaatgaaggtagcctcggttggggagatttttcccagcgtagtaaattgtttggccttcatttccctggtcccctggaggtctgcaagccccatggtcagataccctgtggtttccagtgctgggcggcttacacaggagaaaggatccatgatttctgctttcgtcctctgctgcctcttgatattgagggcccctgcatcacttaaaatgtttattgcagattgttcctttttgcccttctaagtagtctgtaaactctattccaggcaggggctgggagagttattgcctgttgatacactcacccaaataagtgctgagtgttctttgctacacacatatggactttggctcagggcccagaatacctgagtcaatttcagaatccaattgttacagcgggcttgtatttttagagaagaaaaaggtgtgcatcctaagatccaaaagctgtctacatttacattccaactttctttttaattaagaagatcacaaaaatcaatagagaatttactagcaaagagggccatactggaatgatttggggaaagaattttgctgcattgacagaaagagggcaggggaggtgtttaccaaaccatctgtaactggctgggtttttctcatttatttcagattccattctctctattcattctccatcccatcccatccttggaccccatctcttccagaatgttaactatgccccatagctatgaaatgaattttccataagagaacaatttcctacttttatggtgctagaacaattgtgtgcattgttagagacccctatatgactttgacttcgtcagaagagaatagtaactctccattgacaggtcctggtgaccgaaagtataatcaaagtcagtgcattattaatgactcttctttttaatgactcaatcacagtgtgaaatgtttttcaaacattttattttatataatttttccacttgggaaagtctgcccacaaattaagggaacacaatagctgaataaaaccagaaatattgtgctggatgttctccaaacaaattgtccttcaaagagatggccagaagttctgatcaattttttcatgacaagtgggggccagataaaggatatacctggatcaggttacctgagaacacagattgagaactgggctttggaatctgacagccctgatacacctggctttattatatactaatgatatgatctttggctccttttgaaaaagctctcagggttggtttcttcctctgtaaaatgagcctactgaagcctctggaacaggggttgtgtgaagatcctatgagataatgcatgtaaagtgtatctccctgggccttgggttgttgactccttattctgttccaagcacccagagtggagaaaaaggcagggagagcaattccagccgctggctgtccatactgctctgagctctgtgacaggtaccaggagaagaaacagtggcatggggatgggcagggaagagaaatggaagcaagagagagagagactggctggcataagaagagtaagggttacattcagcacaattacctttgagatgtaaacaccaaacaacctccaagggtaaaagaagttcaagaattccagacattggtcaagtttatgtagttatgtatgaatgactttaaaagactttgaaactagtgtgtgtttgtatttttagtaacttactttttaaaaatttgcattttaggtgggggtcacaccaatggttgttggttacattctgcattccctttaacactttattttatatattaaaagagtatttatggggtgcagtcatgaaaatggctaccagttaccaggtgcctcctatatgccaggccttatgttttgcactcttcacatatgagctcatttaatctttctgcaatctctcaatgtattattatcctcattttactgacaaagaagcagaggcccagaagactaggcaatttcccccaggtcacaaagctattaaatggcaaaggtgagaatttgaatttaagtttttgatccataatctctgttttgactccaaaacccattatacaccaccaccaaaataatggatgaggctactattttgatattgctaataactggaagtgataaactaagacacagaaccatattttaaccagggtttgctgtctggttatttttctaacactgttgcctctgaagaaaaggcaggtaaataatgtgtgggtgtgtgtgtgtaaactagtaaatttcacctaatttatttgcatcctttctactgctatttctaacccccatttttgagactatcttaagagtcattgtctagggatgcagctacttaaggagcaaaacggtcagggtcatttaaaatctcttaagcagagaacatttaaattttcttgtttctggctactggtaacaaatcttcattaaatcttaaacacagaataaacaaagcatgaacagattgtgactgcttcctaattcaacaaagagagattacggttttgcagatactgttaaatgttggaacagaccctgtggaagtcattttaaggcccagagtattttcatgtattttggcctctctaaatcagtttttcccagaggaactgacattgccaaaaaatatgcattttgtttaaagttgtctggacaaagatttatgcttctgtgaccatctgcattatcacccatgcaaggcaatcaatactgtcctaatccagtcatatgcctactgatgctttatgtatatttcacatacctatctgcacaagagaaggaagtaattgcacagataaggaaaagcaaaagtagcaggacccagtttgagattagatcctttgactgctgggtccagacatggatgggtatgggaacccacctggggtctacttgaatgagggagaaaacttacccagagagaatccaaattagaatgtgcaagtgtcaaagcctcattctactgagaagagaggaagctttgagtagaaacatctagcttttctttggacaggtcttagatttatttggagacatctgttatggccccttcttgctttattttatggttccctattcacttgacgtagtccatgataccaatatccctcttaaaatatagccatcctccaaactgaacttgatacgtaggtacagccagagtatgatggcaattactgacttttttttttaacttacaaaatttactgttattaatgtagcttaagaccttggctttgcttttgtctccatagagagttttagttacctaaagcctccacgtatttgtaattcatatttaggccttgcaaagatgctcattgttctcaaaccatgattccaaacttagctgcatattggaatcacctgggaagtttcaaaatagtttcctgtatctcactgccagagagggattttgtaggttcagagtgtggcctgggtttggggatttttaaaagactccagatgattccaaagtgcagggaaatttgggaaccactgttctaaccttccaattcaaagtgtggtccatggcactggcatcacttgggagcttgctagaaatgcagatgcttgggctctactcagacctactgaactagactctgaattttaacaggctagctaggtgattcatgtgcatattcaaaaactattaatataatcctgattacaagacttactttgaaattttattaaattccactttttttcttgagcttcaagaagaagctacagtttcatcactggggctcagaccacatgtgaagcaactgggttgggtgtcctcaagtgggtagggttaaggctggtcaatgataaacctggcatcagtattagacattcaggctaattctggatcaaagtgaacacaggaatcagaagaagattaaaatatagttttagctctttgcttgcaaagctgggctgaagacccggatggaatgggctgttccttgtcctttgatttcccccgtctcagctagttagtttcttgagaggggagagaacagaggcctctgctatgaagtggggaggtcctgcctgcaccttggtgagcttgcccccacatggcaccactggcagagaggagaacgtgttctgcttaagaacaacttcagaggaaggacagcgagcaaggtgacagctagctgtagaagtcagtgaccattcgcctgccttactggcccactgagtcactccttccactgggagggtgggcatgtagtttcctggcagctgttgctattctagggggcacagtggaaatgtaggaagaggatataagtcttttacctcatccctttttgttgattgggaccagagagcagttacctggcaggcctgcccaggaggactggtcagaaggcctcagaggaggaatgagacagaagagtgagccagcacggggcctggttgatgggttcagagaatcagagaaagcagctcaaagagcagctgggctcatggtcaccaacttgccttgttcccaaatgatgttagcttcctagtgtcttcttttactcagagagttgagagttgagatttcctttggtttcttgaatttcagacaggtcactgaaggtatttaagaatcttacttatcaatgggtggaagttagtaagatggtaggtggcctttttttttttttttttttttttgtagagacaagagtattgaagtgcccaggctgttcttgaacatctggcctcaagcaatcctcctgcctcagcctctgaaagtgttgggatcacaggcatgagccaatgcacctgcctaaaattatatctcttaaagaagtgatttgtctttcagagatactacctagagaggcgccaggagagaaagggcaataggcagttatttagctttccccttccatcagttctggaacttagtcattctctcgcgtctcatttttcctctaactttcagatgtgcaaaggatgtcttaaactcaacaagacaggagaacagaaaatcccaaacaacccaccagtataaaacacacaaatgtaacaaacacaagaaaactcaatactagctcctctttctccagccaaactgacaatctgcttgttggcagatctctgaaacgtggtcggtgctcactggcactacttcctcaccacagccttgctctttggctcccagcatctggcccctcccaaagggctcaattgaaacctgtctcccaaagggaacatgtggcgtcctcattgccaaatccaaagccgtttcttagctcccgctccatttaatgtctttctgaaggtcattcctttgacatcgttgactatatttcatttctttctcttctggtgatcaaatgcatgagcttaggaatcagacagatctgaacataaatcctaactactgctagtaatgtgaccctgggcagataaaatacacacacacacacacacacatacacacatacagatgtgtatcttttattttgctctatagaaacgggatcatattttatactcttgtctgctgtttgccttactcacttaacagttcattgtggaactccttccaaaagagttggtgtagaactcactcattcttaaatattatggatgtatcacaaattattcaaccattcctctgttgatggatattccatttgcttcagacattttctactctgggttggtgatttcatcttatgggataaatccccagttgggggatggctggatcaaaggacacatgtatatttaatttacatttagtgggtatatttaattttaatagatgttgccagatggccttctaaaaaaactgtaccatttcacattccaccggcagtgtatgagtagctcttcctcaaagcattatagtcctgtttaattttttacaaacctggtgcatttcctcaactactatagaaattgagcatctttacaaacgtttattagccatatttggatgttgtgttctgtgaacctgctacttatatccttattcaagttacttaacctccctaagcttcagtccctttacaaagttattatgaagattaaataaaatatttatgtgaaggctttgcccaaagcctggcacaagtgacatgcttggtaaatagtagctgctgttaattcttttaaattcctttttccttatttagttaatcttcatcttcatacctttaaacatgtatctataagcattttccaaaattctgcaaactaatttttctctttgacatcttgcattctttctttctgaacatttcaattttacagtctctattctgttaaaagaccaatttgaacctctaatcttgacttgtcttttaacagcagaattgacggtttcaataccttgctggaccccacagatttatcttaccatctactccctgccccagcagcaaactctgcctcacaggaacacaacattcccatctgtgctcctgtattcctaaaggcacccttttctccaagacctatgggcttgagatcataaagtcatcatgccgccttgccctagacgttcatgtcagtagaaaagctccataaatcccctttacaatggctcttatagccatcctctctttcattgtttttactctagttcactccatcaacaacaatcaaaatagctaactaaccagtttttcctctgccagcgtctcactttttcaatctatttgttacattccagggaaaatcttctaaaacaataacagaatcatgtcactcactcagaaccatttatcagtttcttctattacagagtaacattctcactggccttggagaacactgccccaattcctttatgcaccgtatttttttcatgcccccagtctctttagtttctaccaacacgccagttctgatcactcacaagtgttttttgctcttctggcctaacagcctacaattcctcttccttctccatctgttggaattttatttattttcagagcctctcactctgttaagatcttccacgtttactcacctagaatgaatcaagtattctagcagtttcctatagtatcccccaatttaattattctgtaatatttattattatagtaggtcattttcacaattcttcttggcctttcctcaccacaagcttcttgaaggccagaatttactttttgttccttataatattttctttcttttctgtgtttcccaatctatttcttatctagtaacttttaagtgctcctttatttatttattttaattttggaataaatgcatgactggggttggagattagggaaaattgaatctggtgaaagaaaggagcgagttgtcttagattctcagaggtagcaatgggaccatgggactggtagcaatggtggccatgggactggtccatcccatagttgtcttttatttgcttcccatacagtagtaagtgaacacatgttttataagttggtcaacatttaccaatcaggatgttttatataagcatctggcttctcttgaaataaggaacatcagcaagactggattggcattcctggacggtatatggatggatgtgaggtatgacaaggtttctcttcaaacagcctgatcaaccttttgttctttaattcccagtacccctccccatctctttcttcttctttccttctttctgcctttactacatgcccaggcatgccacagcaccagtggcgttatcagcaccagctcatattcctttccttatttggaaaaggactggctctctagctcactgcagacgaccccttcccgctctcccctctctcccttacgtgcctgccttatctaaaaaaaaaagtttaaatatttagccaatcgggtctagcttagattgtgaggtctgatcccagccaatggggaaaggacacaggggcaggatttgcatcaggaataaaaacttccactctcctttggtctgtgtgccctcatggcaactggccatacgggaggcacccctctccacagaagtaaatttgctttgctgaaaaatcctttgtctgagtgctcgtttgcttacaactctgagctttatttctaacaatggagatgagcaactgtagccttccttgggttggcacagtctctcatccttgctatagcccccacctacatctcatacccatgaatattacctacgtgacacctatgggcatctgagtctgtaatcacagcactaactccatgtgtgaccctgggctggccaatggatccttgggcctcgtgttctcatctgttcatactttataattacacaactttagtttatcaagagttccttttatttgttttttttttcccatggatctcatgtttaagatattttctccatgaaacagcgcacctattgaacatatttacattgtttcacttacactgtcctctttttccaaaatgattcagattttaaacaatagtccagaattatctggttataattatattatgaaatctcataatttttatcatgtttattttgctaactaagcaacagttaaggcacacaaataaatgcttatgcactgtttgttgctattgtttgctggggtttttttagttcactgccttctatcccaatcacaagtccagtcgagttactgtgacagcctgacatgggcctctggtatcaatggctgggtccaccaggtctgacaattcctgtgataccattaggagccagtcagagctattacaatgctgagttgataaaattgtgtgtgtgtgtgtgtgcgcgcacacatgtgtgtatagagacttgagtagcatgtgtggtagccttgtcgtgaatgtatggataatgcttattattgaaataaccaaataaacaactatagaccgtaacatataaggtaaaatttgaaccctttccactctcaatctcattcccagttatttctttattgttttgaatgtaatggtctaacctttttctttcccttgtgtgcatttaaagaaactgtgaacatactataaattctatcttttgatttgctcttttctcattacttcacaatgtgaattggatatcctttcattccaggacattttcatctgcctcattcttcttaattgcttcctatcattccagtgaaggcgagtatcaaaaagtatttagctagtttcctgctgatagacatttagtttgtttccaatcctctttccaatttaatgatcagttttcttgatgaagaaggtggaggtaaaatagttattacctgacagtgtttctggccaaaatgctaactactgataggtatttgaaagttgactccctgtattcttgcaatatcctctgaattattctgtattctgaattatttgtaactgaattattctgtagtttactttttcctaaatgagaatctggacttaatattggctaccctttttattcataaagctaataactcaggttctgagcacttattatgtgccatgcgcatgctaaatactttacatacattatcccatttaatccttccagtagtcctaaaggcaaatactatactattatgtcaattttacagaaatgtagacaactaatttgcccaaagtatcataggtgtttaaggggggagagtttgaatacacacaaacccaagctagaagctatgctcttaactttgattgatgagagcacagggtctgttttctcagggtctattttcttccctgaatcctcgtgtatgtgaaactctaacagcagagtgaggaagagaagaaaggacttccctgtgtgctgggctaagagtgtaatcaggagcagactgttcctaaaaacagggttgtaggagcagcagtaaaagctcatttctgttacaactttggagacccctgtaatgctttcaaattagaaacttttattagtccatgttgtgttgctataaaggagtaaccgagactggataatttattaaaaaaagaggtttacttgactcatggctctgcagaatgtccaagcatggcaacagcatctgctcagcttctggagaggccacaggaagatttaacttatggcagaaggcagaggggagcaggcatgtcacatcgtgagagagggaggaatgagaaacaggggtctcttttaaacaaccaggaaagggcacaaactcatccataaggcaccccaccccatgacccaaacacctcccactaggcccccactccaacactggggatcacatttcaacatgagatttggagagcaaatattcaagctatatcaaagctctgcaccaaagctctatgctgatctcttgagaacaaatttatgcttgttgcagaaacacaggctatagtagggaaagctttggactctgaagctatagatttgctgtggaccagctatgaccacggtttcctccaccagaggataaggcttggatcttttggtctctgacgaaggtttttattttgaaataatttcagaattacagaaaatgttcaaaaatagtgcaaataattcccatttccatttaccttccacacagaatcctcaagtgtttacattgttccatgtttgttatgttgttctgtctcctctctccttacacacacacgtatgtgtttgagtttagtaaatgtcattatcatgttatttctatttcccaacttttggggaataagatatgaacataatgccctttacccctaaatatttcactgtatattaagaaacagagacactctcatatataactgtagtttaattattaacattaataatagtaatcttatctaatttatgcaccttgttcaaattttgccagttgtcctactaatgtcctttaaaataaaataattttcttttttttctggtctaggatccaatacaagataacatattacattttttgtcatttctttatagtcttctaaaatatggaaaagttcctcacaaaacgtatgtttgtcttttgtgactttgacatttttgaagtgtataagccagttattttctggaatatccctaattttgatcttaggatatccctaattttgatctgttcagtttttctcatggttagactcaggttatgcattttttcagggaatatcacagagcaatgttgtgtccatcttggtatatgacatcaggaggcaggcaatggatgtttatttatctcattacaggtaatggtaagtttcaagacatgatatggatggtatctgctcaatttctttcttataaagctattattatctttttgtaattaatttatatctttgcagacatactgtggagacataatgtaaatatcctgtttgtcatcaaactttttacccaatagttttagcaacaattgatgattcttatgtgaaacattatttctgtgttgcttatcaaatgagtgctgagactcttgctttacaacttttacttacaaagcgcttactgaacaataataaaaaaattttagtcacttcagtgccatgtagataagttcatcattcaacttggattagccatatttaactttgcaaggtctaattatggataccatttattaccgagattaagagtaaatatataagaaagatatagttcttaacatactgttactttaaatagatttgattagaaattttgctttgtgaaaaactactcaaacttccagtgttaaagatgaaggtcattcacattggaatttacactcttttaatggcttatgtatagttgaggtccacttacttgccaaattcaaacatttagattcaaggaagaagtccaactgaatttcatgattgttctcaaggggacaaataaaagaaatatagacattcagcacttcttggctacaaagttaaccctagggattaactttccacagcacacgtagcctgtgctctctccagcccggctttcatggtccctactcagagctcagcaactccactgaagtcttcaggaaaccactgaatcatttgggtcagactggcttgactgggcctccttgtgctttgctgttctcccaaagcatggaaagttttaatctaaacaatcattctttaactcatgagcagcttttcacctccccctttggattttgggtctgtcgcttctctgtcctatacaaagcaatgtggtaacaggcgtacccattaaaactcgtccatatctctacacatttagctgttatcattcctaccttacaaacagatggaaaactgcaggagataacttgtgtgcattggaagccttttctataacttctacaaagttatttttcatacaaactcatgtgttcaacaaccagttgagaaaaatcttatagattaaatgtgaaatcaaaagcaatgcagaatttctagaatttgcttcattgattttgtcaagttatacatctccaaggaaaagggggtggccattatcttttcctccaggtcctctcttcattctctcttccctctagcagggggaaaggcaggacttaattagggagggcactgatagctgatgattaccaaactaatgctggcatcaccctaattggcacctagcaccttgtgttgctgagtaggagaaatttcttcctctaatttgtgcttctgaagcatctacagatctggcaatttgccttgtcttcttttagtgccagcaagcactaattactttattatttgatttacttcttaatgaattggtgacttgatttaaaaaatacttattatatatttgcttggtatcaagaactaagctatagagtggaatacaataacaagacagaatatctctgccttaggaggaaacagacatgagacaaataaaatattataatattctatatagagtattacgggaccatggagaaaagaacgatttattctgtctgcaaaaataagagaaggcttcaaagagaaagtgatatttttgctaggtattgaagaacaagaggagttcctcagaataagaagcgaataaagattttaagtatgtacttagaggtatataaaagtatagtgtattcagacaaaggtttagagtccaatgtggcttaagctaatgccatttggagactactcaaagcagtaaggatagttaggtagagtgtagaatcagaatcaagactaatgcaggtttccatttaatgtctgtgttttactagcatagtatggccagattaatttatttagtctttctaaccctgtattatctcatctgtaaaatgaagataatactcatttctcagggttgttgtacagattcaatgggaatatttataaggtgcctggcagaaagcctgggaaagagtaactttttaaattattttattttatttttcttttactatgctttggtctacttcccctaccaggtagaaaggtaagaatggcaactgacgagcctggaagtagaattggggcccaatgttgaaagcctaaaatgccttgctctggggtgtagatttcatgcgtctggtcagctttctttcaacaaattagatttgcttgaagctccaaaagtctactcatttggtttcactccaacccaaacaaattccatttccctgagagctgccaatcatggctaagtgtatatctgatatctaaataaaatggttcactggaaggcatgactatagtaaaaaagagaatgatgcaactcagaaaagaaaaaagaatcttcaacaacaatttaaggaagtgttaatcagcattcaggaagtgaggattgagaaaatacatattgccacacacatgcatgaacttgaaggacaaaattgtgttagacaaattgagttagatcctcagtgattccaagatcttgcagaaacagagaagtcctcagataagggaaaggtgaaatccagtcaagcagagaaggggcttggtgagtgactttccttttacatcgcactcagataacagaaaggaaatttcatccaaacaggaagatcaactatggctagcccgtttgcactatatcccaaaggaacccatatgtagtttatgtgatcaaagacattcaggggaaatattagaatcttttaataaagaatgaccaataaatagtggtcggcattgtttcactttccatatgttttactgcccaataaaccaaagagaaaaatatattttcagagcagaaaggggataatagaataggtaaagacttagtaaagtaggtaaagtaggtaaagacttagaagaaaattgtaagaaatccaggtggtaaataaaatctatattttaaattgttttcttatgcatattttaggatccatgataaaaactatgcagtaatggttaacctgtagtattaatgatgaaaaaaaaggcataatttttaagaacgtgcagagaatagtaatgtttgatagcaaaaacataagcaaaaacaaaacaaaacaacaataacaaaaacccctttgcagataataacaggaaaatagttaagtaaattactatctctcatttggtagaattgcatgctggtattcaaatatgttttgcagagctaccatttgacccagcaattccattactggatatatatccgaaagaaaacaactagttctgccaaaatgacacatgcactcgcatgttcataacagcactattcacaaaagtaaagacataaaatcaacctaggtgcccatcagtggtggattggataaagaaaacgtggtacgtatataccatagaatactatggagccacaaaggagaacaaaatcatgtctcttgcagcaacatggatggagctggaggtgattatcctaagcgtattaactcagttacagaaaaccaaatactgcatgttctcacatataagtgggagctaaatatcgagtactcacaaacataaagatgacacaatcgacactggggactactagagtggggagggaaagggggacaggagttgaaaaactaactgttgggtactgtgctcagtacctggtgattggatcatttgtttctcaaacctcagcgtcatgcaatatactcaggcagcaaacctgtacatgtatcccctgaatctaaaataaaagttgaaaacaaaaccaaagtgaaattttaaaaaaaaattgttttggaaagtaatattttagtagccaaagagaatatcatcaaataatctaaataaacaaaaaaaattaaagagagataaagtgactacatataaatgaaaaacatgcatcatagaaaatgtaacaacgttaaaggaaaagtgtcagactagagagactatctttgaactattctttgaactatttattaaaactacttgtaggaatttatcctatatacatactttcatatggtcttaaaaacacatatgcacactcacacttttgagaagattgaacactggatatttgacatgtagaaattggtgttaatttgttaagatgtgatggtgctatttggctttgatttttaaagtccttttttagggatataatcagacatatttgtagataaaataatacgatgactgggatttgcttcaaaataacccagtgttttaagggcttggggagaagctggtaagttcatagatcagatgatttgatgattgttgaagctttgtgataggcacagaatggtttagtactatgtatgctttttctacgtttgtgtatgttggaagtgtcctataatagaattgtttaaagaaatatacagaaccgtgtatatagtatgcttctgtttacataaattaaaggaaatgtatgttgtgtatgtattttttcatttatgcttatgtttatataaaaacatagctgtaaggatagacaagaaagtaggaacagcagttgcctatcaggaagatagttatttgacttggaggtgttttaggaaggaaacttattgttcatggtatatatacatctactatttaaattttctaccagtatctgtattccattatatgtgtgtgtatatatgtgtgtgtatatgtatgtatatgtgatacactgacttgaatatacagacacacatacatatataataaaaaatgatttattcaagatattaatttactgattttctctagtacatgtattcatctatctatgcctttagtataaatatttgcatatatgcatgtttgtatttatacacatttatatatttatatgtttgcatatatggtgaaatttgtgtataaaacttttaaatattctcagttaagatcagaaaaaattttgtaatctgcttttatcattttctccttaatatatcagtcaaaacctgattttctgaaaagcataaatttcaaaagttttcactgaaaaaatggagaaattttgccttttaaaaaatgatatgcggccgtgtgcggtggctcacacctgtaatcccagcactttgggaggccgaggcgggtggatcacgaggtcaggagatcgagaccatcctggctaacacgatgaaatcctgtctctactaaaactacaaaaaaattagccaggcatggtggcgggcgcctgtagtcccagctactcgggaggctgaggcaggagaatggcatgatcctgggagacggatcttgcagtgagccaagatcacaccactgcactccagcctgggcgacagagcgagactccgtctcaaaaaaaaaaaaaaaaaaaaaatgacatgcaataactgaagttgatttcttactggagtaatgtgtggaatgtttctcttctgttttgtggaatccctcctagtgctctcaccttctctgggggttttcttctcatttctcttaatgaacaagtcaaggaataaggtgtgtgttgttgctcactatacttctgcctaccaccacctcttccactgggtgtagtggatggggaggctttgaaagagataaatgaatgtctatgtgtatgttggatactctaaagctcaaattcctgaatgtggcatttttccaaccaaaaacgcatatgagcagactaatacattttaaaatatcaattttcaaaaatattttttatttcatgactaaaactcttctgaaaatctgtcccataattgtgttattattttttcactcatcccacttattttgtgggtctaatgagatgatatttgtgatgcattagttaagttggtaataatgggtagctcttcatggaaataatgaatatctaggacaaaggtaaaatatcattaaaaggtaaaatatcattaggaccagtaagttttacccagtgtcctgttgaaatttacatggtgagtgatgtcagcaaaaatggtggaaaaagtagtttcaagggcctgttgcttttggaaaccaagaaatcaagtaaaagctgtcagaatcaactttgtcagcacgctggaaaacagtcaaatgtttacagcaaccaagtgaatgcttaatcgaaaaagaaaaaaaaaaggcaactttaaaaatgagcggacaggcacagtggctcatgcctgtaatctcggcactttgggaggccaaggtgggaaaattgcttaaggtcagcagtttgagatcaacctgggcaacatggcaagacaccatctttacttaaaataaaataattgttaaaaaatgatataaaaacttcaaggtacttttacataccctttctatactcccctacccggcttggtagaatttttgaagcccatgttcccagtgtgagaccgtgtccctgattttgtagggagaaagcaagactttatctattcaaacaaatcttggggcttgcctgagggactgatgcaagttgtttgtctttattttgcctaaacttgaactcattcagggtgaaaaagcagtgggtatttcttgaaaatattatagggtcaatgaacaacctccagccacctggggcaaaaggttgtagttgaggcaaataatgaagaactgaaatcctgggaggaaaaactggaaagatagtttatctgggaaactaaatcattcaaaagtgtctgtatatactggagagattaaaaaccacatgcacacccagtgcaggacacctgttagaaatgacatgagaagaccttgagctatcaactcatgctgattgctaggccaatgcaagcaggaagtgaaggttaagacagaattttaaatagcatggctaagcaatcaaggagtgccctaacacagagctaatttcaccagatgatttcaataaaagattcaagtaggtagaagaaagaatcagcaaactggaagtgggtcaattaaaatgatctcatttgaaaatcagagagaaataagaatgaagaaaagtgaacagagcctaaaaaacctgtaatatgtatgtatatgtaatacactgacttgtatatacacctaaagcatattatcatgtgcatgattggaattacagaaaaataggagagagaaaaagaggcaaaagaatagccaaagaaataatggccaaagctctccatatttggtaagatgtaaaaatccacacatataagaagctcaatgaatcccgagaaggatcgacacaaagagactcacggtgagacacattataaccaaactgttaaacactagaaacaaagaaactctgaaaagcaacaagggagcagtgacttgtgtccaagagatgctcaacaagattaaaagcagatttctcattccatggaagccagagagagcaaaatgatatatttaaagtactcaaatgaaaagacagaaacaacaacaatcaaccaagaattctatatctgacaaaattatccctcaaaaatggagaaattaagacatttacagatggacaaaatctgaggaagttaatagtagacctgccctataggaaatgttaaacagaattattcaggctaaaatgacagtaagttgaagtcatatgtagaaataatgaactctggtgaaggtaaatgcataggtaaatgtaaaagccagtattattttatctttggttaataactcctcttttgatttcttatatgatttaaaaggcaaatgcacaaaaagtataaatatatggttaattgcctcacagtgcataaagatgtaatttgtaacaataacaacataaagcaggcaaaagctgcatttggacactctttttatctattgaagctaaattgatatcaattcaaaatagattactgtaaatttaggatgctaattataattcccacagtaaccactgagaaaatatctttaaaaaacacacaaaaagaaataaggaagaagtaataatggcacactaaaaaaaaaaaaagtcagttaaccccaaaagaaagcaataatgaaggaaataaggaacaaaaaaagtataacatatacagaaaacaaatagcaaaatgacagaattaagaacttccttatcagtaattattttaaatgctcatggataaaattttcccaaaggcagaaatggtcagacagataaaaacacgattccagagattactttagatctaaagataaatgtgggttcaaagcaaaaatatggataaagatattccatgcaagtagtaaccaaaagaaagccagggtggctctactaatatcaggcaaaatgatcttttagtcaaaagctattaaaagagagaaagaaggacattaaatattaataaaagagtctattctttaagaagccatagcatttataaacatataggcaacaaacaacagagccaaaagatatgaagcaaacactgatggacttcaagggagaaatagatagttctacagtaactattagagatttaaatatcccactttcagtaatggatagaacactgaaatggagaccaagaaggacatagagaacttgaatagcaccatacaccaactagacctgacagagattttgaacactccattccacaacagctgaatacacattcttctcaatttcttctgggcctgtttccagaatagaccatacggtaggccacaaaaacaattttcaattaatttgaaaagactgaaatcatgtaagtgatcttctctgaccacaatgacatgaagttagaaaccaataacaacaacaacaaaaaatactggaaagtccacaaatatgtgaaaaataaaattaaataacacactctttaataccaataaaccaaagaagaaatcactctggtaaattgcaaaattcctaaacatgaatgaaaataaaaacacacatacacaaacttacaggatgcagaaaaagcagtgctcagagggtgacttatagctgtaaatgccaacattaaaaataaagatctcaaatcaataatccaattttgcactttaagaaagtagaaaacaataagcaaactaagcccaaggcttgtattaaaaaaggaaataataattattagagcagagataaatgaaatagaggatagaaaaacatcagagtaaacctggaggaccttgactaattcccctgactaaacgaaaatggtgatatttctatagacctacaacaaaaatatcataagagaatattcgaactattacagaacagagataaaattgacaagtctctagaaacatacaatgtagcaaaactgactcaagaagaaacattagtattagtgttctccagtgaaacagagctaagaagatatctatatctctgtccatccatctaatctatctatctatctatctatctatctatctatctatctatctgtctatctatctctatcaagatatttattataaagaattggttcacttgataatggaggctgaaaagatccaagatctggagaaccaaaaaagttgagaatataagttccagtccaatggctttttgagtctggcaggcttcagactcaaaaacaaccagtgtttcagtttgagtctaaaggcagaaaaatagcaatgtttcagctaaaggtagtcaagcagaagggtttctttttatttagttttttttgtactgttgaggttttcagttaactggttgaagcccaagcacattagggaggaaggacagtctgcattactcagtctactaattcaaatgttaatctcatccagagacactgttacaaaaacacccagaatgatgtttggccaaatgtctgggaccagtcaagctgatacataaaattagccatcagagatatagttaataaaactaaaagttagatccttgaaaagatcaacaaaattgtcaaatctttagcaagacgaagaaaaaaacagaagttgcacttaattgaaatcagaagaaaacagaagttgcacttaactgaaatcagaaaaaaatagaagttgcacttaactaaaatcagaaatgaaagtggtgacatttctatagaccttctaccacgaaaagatcataagagaatatttgaactattgtatgctaacaaattacaaaacatggatgaaattgacaattctctagaagcatacaaggtagcaaaactgactcatgaagaaacaaaatttgaacagatttatataacaagaaattatatcagtaattaaacacttcccaacaaagaaaagcctaagaccagatggttttactggtgaatctactcaacatttaagcaattaacagcaatccttctcaaacttttccaaaaaatggaagagggaacatgttctaactcattctatgtggccagcttatcctgataccaaagccagacaaagacatcactagaaataagaaaattatggaccaaaatcccttatgattatagatgaagaaatcctcaagaaatactagcaaactcaatttaatagcatattaaaaggattatacattataactaaatgggatttatcacagaaatgccagagtcattcaataagataacagcaatcaatgtaatacaccatattaatagaacaaaggaaaaaataattatcttaaccagtgcagaaaaagaatttgacacaatccaaaacctttcatgagaaaaatactcaaaaactagaaatgggagaaactttctcaacatgttaaaggacatttatgaaaacctgatgattaataccatggtcaatggtgaaagactgaaacctttctctttaaaattaagaacaagacaaggatgtttgctttcaatattgctgttcaacattgtactaaaagttccagacagaggatgtaggcaagaaaaaataaggagcattaaaattggaaaggaagaagtaaaactatttctaatggcagataacatgattctctatattaaaaattccaaaaatccacaaaaagagaaaactgctagtgttagtaaacaaagtcagcaaagttgcagggcacaacatcaatacacacaaatcagttgcttctatataccagtaattaacaaactgaaaagaaaattaagaatatacttttctttagaataagagcaaaggaataatatatgcaggaataaatttaaataataaatgaattgtacacttaaaacaataaaacattgctgaaagtaattcaagaagctataaataaatggaaggcatctaatgcttatgaattagaagacttaaaattgttaagatggcaaaaatacccaatgctatgtatagattctatgaaatccctctcacaattccaattgtccttttttgcagaaatgagaaagtcacctactagaatagcattaatccaaaatctgaaaatagcaagtgttggtgaagatgtggagaaactggaacctttatgcaatgctaatgggaatgtaaaatggtacagcctccgtaggaaacagtttggcagttccttaaaaggctaaatatagaattacatcatcccctagaattttcacttctaggtaaataccccaaagagtgaacaacaggaactcaatcaatacatgtgcattgaagcactacgcacaatagccaaactgtggaaatgcatgaatggagaaattaattgtggtatacaatggaatattttttagccataaaaaggaatgaaatactgaacatgctatactgtgggtgaacctcaaaaaagttatgctaagtgaatgaagccagacacaataggtcccatattgtataatctcaattatatgaaatatctagaattggtaaatccatagttatagaaattagttttttcattgccagggggctgtaatcccagcactttgggagaccgaggtgggcggatcacctcaggtcaggagttcgagaccagcctggccaacatggtgaaaccccatctctactaaaaataaattgctgagcgtggtgactcatgcctgtaatcccagctaatcaggaagctgaggcaggagaatcgcttgaacccaagaggtggaggttgcggtgagccaagattttgccactgcactccagcctggcaacagggcaagactccatctcaaaaaaaacaaaacaaaacaaaaaacattgtcaggggtttagaggagggggaaatagctaatgaaattattacttattgagtaaggaattccctttggggtgacaaaaatgttttggaactagatagatgttcacatagttgcacacattttgagtatactaaacgccattgaatccttcactcaaaatggttaattcatgttcttgaatttatctgaattgatacaaaagtaaacacaatacatgtcttctttacttcagcttctgtttaccagactacttggtgagaggaaatagattcttagagtctgacagacctgggttcaaattcctcattcattcattttatccatttgataagttaagatataaatatcaccacaacaaattgttgtagggattaaataagataaacaggtgcattaatgaagggtaagtaatactagcttcaattgctagtgtttctttctaatgcagcagtccattgtgggtattcctgagtagggaaacattatctatggtcatcaggcacttactccttaggtccctgtagtattcttctatcaaccagcaagcagagaaagacatggtagatctcttatggaaagttgttatgagatggtactggataatggaatacatcacttcttttcaaactccactgatggtaactcagtgtcattgccctgcctagccacagcagaggctgagacatgtagactgtgtttcaggaagaagaaaaagatttgggtgaggaaaaaaacaactcttgaggtatcgtacttgtatgaagcttcttgttcagtttgtgataagcacttaataaatatgaactctcttctttgtgggtaagtgagaatccctggcagcttctgcaaagttgtttcaaaatgcatgccatcctgatgacaggccactcgttgtggccttatggcaaagtcagttgatagggctgccaggcagacagtgagcagaattctttctggactctgttcctgcttgttctttttttcttttgtgttttggaacttcccttgactttggtcccatttagtttcccaatgtctaacttgcatttacccttctttcacagcttgctcacctttagcttctatctgactaggtctttgtgttttcattttgccctctcaacaaactatttctagtccttagctcagtagcttcactgagcaggcccataaactcccttttgccatttccacttcccagtcatatcttgaagacttccaacttaaacacattaatttatgcttgggatgattgttaaaatttctctattcctacatcttgtaattagcttagctgatttttaaaacaaatcctctaagaattatttttatgaaggccatctggtaaaacaaattaatctccaaggaatgttaatcagactaattgctaattaggtgtcctccttgattctattagttatagattggaaagtgtttgtcatatacattaatttttgcaaagatagtgagaaaacattattttttgccctgcaagagaacaagtgaatccatttgcatgtataatgtatgtgtgtggtgatattaaaagatatccattttttgttgttgttgtttttttgagacagagtctcactctgttgcccaggctggagtgcagttgcatgatctcgactcactgcaacctctgcctcctgggttcaagtaattctcctacctcagcctcccaagtatctgggactacaggcacatgccaccatgcccagctaattattgtatttttagtagagacaggtattcaccatgttggccaggatggtctcaatctcttgaccttgtgatctgcccgcctcggcctcccaaagtgctgggattacaggcatgagccactgcacccggccactacacacagtctttaaacttaaggggttgaaatttattctaattgttagtgtctcagcttcattattcctcaaatggttttgtggttcatggagcttcagaaatatgtttttaaacatacaaaaaaaatgccagtggattcaactcaatgaaagatggcaaatgagtttaattttatataccaatggtctgataggaattaccttgagtatattgtagagaatgcctgggtgggacggggatatttaccatgcactcactatgctcctctgtaatggactgagtagtgattcacaaaaatggagccacaaataataaaaaatcatttgtgctgaccctgaaaatgtgagcctcaaaataagacaaaattaatcagaaccagacaaactttaagggaaaccctagttctttattgaaatgtctttgtgccaaggtagttaagtgaaagaatggatgaaaaccaaaattcgtactctcccccgctcaactatttagcctgaggtaattattcacttatggaaaggagtgagtatttttggtcaaagtaatttaggttttatgaatgatttcttcctgtggttttatacatatttgtagagagtatgaatgacattctccctgaatttgtcttctatttagtggtggattggtttcacagttgtatgagacttcagggatcttcctttttcctcttttgttgtgaattctctttttataatagaagcatgaaaaaagtctgcctattagaaatgtgaccttggaatccatgaatccatgaatccatatttggaatccatatttataagaaatgaaatgtggtatcaaggaaggaattttgtctggaaagtcagatctgaattctggtcctgcctctctgtcagtgagccctgtggttgtggctaagttgttccatggtctctaatgacctcaactatgaaataagagcttggggttcagtttttaggtagaataatgctgtatgttgatgttgacattctgccattctgcagtgatatattgcttaatttgcctttgccagttattgagcacgagggggcagtaattggcagattgccccctttatttcttcttgacaaacagccaaattttttggcagctgggaattgttattcttcaccatcctgccatcactgacagatgcatttgacaggaccattggcttgcaatgccattccactcttacaagtaaagtctataatgcttaaagaaaaataaaaacatatgatattcaacttttacaaaagagtacatataatattctttatctgtcaatgtaaaaatggtcagaaacttttcagatatatttgattttcctttccatgaaggcttcatttttgtaaggatttttaaaaattaatagagaaaaaaaccccataaggactctcaaaccagtggtctaaaatggaattaattttgtccccatcaattgctatttctttgcaaatatttcttatcttggtgaatgatgaaccatttagcctctgacccaagccataaacctgttagttgtcccccttagcttttcttttcccacacccctccatcatcttgcattctgtctaattgattcagtaaatctggttgattctacttcttgtgtatttttattatttttcctttcttctccactggaaacttttatgactctagtttatactctcatctaggtcactgcctatgtccctaagttgtatccccagtgtctaatgccatcacactccctcctttaccctcaccccaggctacacttgaacaggtagagcagggaatgccatgtagacctcatgtagccaagttggaggccctttccagttcatccccttgactttattttaaataatacatgaataggattgcagaacttttttttttgttttctgtgatgctcatgcttgtgcttcttctgttcaatgtgacaaggaacaagatctctacaatgaattgtaccaatgctccaggaaatacttgccccatttttttttaattttagtttggtttaattcctctaaagtaacatcaagcaatgtgctataaaacagaaatatgtcttgagagatagttattctctctttctctctctcaatttaaaaagggttcaattttttactgcttcaggcaagtacaattttcacatactctgacatctcatgaaacctatagccaaagatttaggtataacctgaattcttccccttcagctcagtctttgattgtatacatgctcatccctatcctcaagaagaagtttacatcttatctcctctctgaaacccgtatacaacaccccaattcagtaattttgctggggactcctaatgctcttcttgtttatatatatcagcagctaacgcctgttttgtatgagctttctctatatgtatcatgatttgccaaaaacattgtcaactctttgatggcatagaccctgcaattaagccctcagattcccttgtttaactgatggcccagatagcaaatgcttgaaattgaagtaacgttctccttagcctctaacctgtgtcatcacattagctgaccttaatcagggcattaaaaacacctaaatagagactggtggccttcgaaggaggtcttttttgtccttagaatttttaaataaatcccactgtcaaagtcatcaaccacaagggaagtagaaaaggtggtgttggtctttagcacaattaaagaacctattagctaaatccctggcaggccaaatatgaaggcaatataggtaagtcttattacactctgaaaatcaggattaaatatttacaagtttgcataacttgacctttcttgcaaagagtattaaaactgtttttaaagaattccttctgctcctatgtaaaagggcattcataaggcctccttccacaggtggacaaagtgttcatctttggacttactgataaaaattttggctcttctgaggtagtagcagagacagggtagtcagggtagacagggtagaatgctaactgtatcctcaccacctgacaatagaagtttaaagatgtaaaagtatgataacatacaatctttcaccccattggtccttgttgtcaatagctctggatagctaggaatgtatttacttccttcttttgccagggttcattatttgtaccttgcaaatctgaacatttggccaaagtctatgaccttttgaggtacaaggaaatggatttttagttaagaatatttacaaaattaaaattacaaaaccttgtcccagctaaagcttgaaacacatctgtgtttgttcacagcttgtaacatttgaggctccccatcatgttaaatccttcctttttattttaaagtttgccttctcatatgccattgttctcctttatatttgagatgatggtctaggttttcagacagctctgggaaggcaggtgttaaattttaagctagtgcttggtaacctccatggtgaaatatgccactgtttaacagatgactactgtgctgtggacagcagtgccccaggagagaggaggtgtttgttccagaatctaatcaagctatggcctgtctgcatcctaacttatgcagtgtaatcacttgtatcattcgtggcatgtcttccattaatcagagctagtgcaggtaccaagggaacaggggttccattagcatgacatatggtggccttcccaaagttttggatgttttggaagatggttgcagggtttgtaccagtcatacaagagctgcttaatgacttagatattagtaaactttttcccaggcatttaatatcttccccgtttcctcttagtaatcgtagttaggttcttgatgtcccctgtgacatttttatatccatcaccttcaggtccaaactgtttgatttgctgcttcatcttggactcctcatatgtgcttctagagaacaagtatataaaaaagaaagtatgttttcttaattgcaaaagtgatgaatgaggtaggcaatcaggactgtttttcatattttcagagatgctgaaaatacatttagatttgttttcagaacaaaatgagaaaattgttttggaaaaaatgttataagtttggttactttggaaatgtcttcataaatactcatcttgataatataatttatctttgctagtctcatataacaatattgttgcctttaaaatggaaatttgtaagaagtttaaaattccagctttacatacagccccctttaaacctccccaggcattcatagatatgttaaaatatatctaaaataatactaaagcattacatttttttaccttattggataagctaatataaaagatgttttatccatttcacataattttaaattttaaaaatatgaagaccttatgttatttaaaatttattaacaatttatacactcccttctcctgacaagtccccatatattcttaaagataaattccctataaccattttttaaagtaaatggtatatgcttctatctgtcttggctatcacgcatctatcttggaagaaaattgttgggttccaggactgaatattgtactcacatttggataagacaaggatggggctctaagaaaaaaagcaagagagagttgtgtgcatcacaaagatgatgcctctcccgtgtccccatctccaagaccaagcatatacagaaatagccacaggtggctagagaaggaagaccagaagacatccaggagcatatggcaaggcaggaactattccacattgcagggtgagggaagagttaaactggtggagagcaaatcagaaatgcggtgaattcccaaaatattgggacaacaacaacatgactttggctattgtaggggatgaaaataccttttccacactcatcttaggttcatggctgaagcccctacaacaaaatacagattaataagagaaatgtgtatgaatttatttaatatacattttacgtaatacagaagccttcataaggaaatgaagacctgaagaaatcataaatgtttgtatttttttgctaggtttgacaaagagtggacactcacgggcatgtatgattggaggaaaaaatgttttaatctaataataacaaactgggagaaacttagaaaggcctatttgttcagattactttctgtgtccttgtgtcttctgagataagaatattccctttttctgggtacagggattgcacctctcacatgatggtcacgtgacttcacaaaggcgaggagaaggtgagagtgatccccttatttgtccattctcatgctgctaataaagacatatctgccactggataatttctaaaggaaagagatttaactgatttacagtttggcatgactggaatcctcaggaaacttaaaatcatggcagaaggggaagcaaacacgtccttcttcatatggtggcagcaaggagaagtgccaagcaaaagggggaaaagccccttataaaaccctcagatctcacgagaactcactcactatcatgagaacagcatgggggtaactgcccccatgattaaattacctcccacaacacatgggggttatgggaactacaattcaagatgaaatttgggtggggacatagccaaactatatcactgccccctacttctgctgttttctcatacaccagcatgccatattttggggtagtgtgtcctgaaccccatcactatcatgtgatggatgattgggttatatattctatccagcccttactctcaacctgagatagctaaagttcattaaaatagatttttgcttctactatgtatcagggactggtctaggtacttgacacatatcagttaatgaaacagaattatcactatccttgtggagtttacagaaaataagcagtaaacttaacaaataactaaattatatagtatgttaaaattgataagtagaatatatatttttataaaatgaagatgagaaggatcagaagggtcaaataattggggccaaggtccaaggtggggatgtcactgcacagtatttaatggggtggttggttaggacaggcctcattaggaaggtaatagttagataaatttttgagagcagttagggaatttgacaagcagatacctgtggcaagagcattccaggaagtcagaacagtaataacaaagactcaggaaggaggccagtctggctggacactgtggccagagggagagaggaggggatgagtgccgaggtgcaataccacatctgatcatgtaagtccatgcaatgaccttgacttttactctgagtgaaacaaagcagttttagcattttcagcagaggagaaaaacactctgatttatgttttcaaatgaatccttctggcagttaaatgagaatagacatagagagatttttgacatcattgctacttgtctggagttctcattaagacacagacctagaattgtccccataaatatttaaatcagagtcaccaaacatgacctggtgtcaaaccacaacctggacagaaattaattgcattgcacagctaaacctggggtctccctgctggccatatcagtggacttgccctgatcattttcttaatcttacattaacacaccacattatatgcaattgaattccttagatgccacttattattttatggcagttttactgaatgtatcgaaacccttaaagatgttctttttctttgacataacaattacactcttagaaatttccttaaagaaaattatctaaaattcagaaaagaatgccaaaagatatttaccaaagtataatagtatataatagtgtgcgtatatatgtatatataaaatagtgataaattagaaatgatctaaatatacagcgatgaagaaatggttaaaatactatggtgtatttataaggtaaaacactatacaccattgaaaacaatgttaattattggaaaattcttatgaaataatgcaaataaaagtaggaaacaaaacatacagaaaaaatctaaaaggaaatgcagcagatgttagcagagtctattcgattgtgtaaaatattcttctttatgttcctctgtatttacccttcttccatccaccattttcaaattattttatgaagttttctccagaagataccataatgaaaaagcttagagacaatcccaaggtcaagttcagagtgtatgatagaggccctttggacttgttcagggtgagagtggtgtatctgtaggtgatttagggtgacgtttggaatctggagatctcagtctacatgaatacattgctcatctggcacttgggtaggttatactttcccaggtagttcagctttaaagaaatgatcatatcctttaaaaacaataccagtcaggtgcagtggctcatgtctgtaatcccagcacttaggaaggcagaggtgagaggactgtttgaacccaggagctcaggaccagcctgggcaacatagcaagaccccattcttcacacagaaaaaataaagtacataaaaataaaagtaatatcaaaaaatgaaaatacaatattttaaaacaaaatcttgaagtgaattcacaaatttttcagatgtgtgtttaaatacacatctttctccttgagagtctagcttctatgctagtggttctcaaagggggcttaaacttgttagtaatgcagataattttaggattctatccccgacctactgaaacagaaacgctgatggcaatctattggtggggctcaggcgtgctaccccaaaatgctgcacctttggcatttgagaaaacagcagacacagaggagggtcactcttactttttcctctcccttgtaaaatcataagacccttatttgagaggtgccttcgctatacccagaagaaacatccttatctctgaagacaccgggacatagaagaatctgagcaaacaggccttgctaagtttccccgagtttatcacctcctttgtccagtcatacttctccgggactgtccactcttcaaacctaagcataaaagtacacaagctaatctgtttctttgggtcttcattttctcatgaagtctcctatgtcatgtaaaacttatattaaataaatctgcatttatttaatatcttctttgtatggagcctccaccatgaaccgagcaatgggccaggaaaagacatcttttcctcccctacaacgtgttttaacaagccctccatgtgattgtcaggcagggctctaaatttggcaagcactgcttggtgttgagtattcagaagtgacagactttggtagactccaggctcagcaggcagccctgccttcagagcatccgtccatgaaaacggatggaaaatgcagaagggcctctccctatcagaaggagaactgagccccaatcaaggtgtagattagtggttgggcatgtagaggagggctgatggaagattataagcagaccatttccagagcaacaaaaaatgtaggactgcttcctatttcaagttctatttctagtaacccaaactgatgttagatgatcacagcaagaaaaaaaaatgtgccaaagctaattcaggaaactgccacctgtttggggtggggtagtcaatatcacaggtagaatggaagacttcctttgcacttctgactaatggattaaagtgacaaaattcaaactgggctgttaagtcattctctataatattgtggaatcgctaggttttataagctcagaaggcatctcaagtttagaatccaagagtaaaattctgttctcagcaagcttcttactgccctgaagtaatttctcagatgggcccacgtgtcttctgcccctggctatctcttacttgtggcttgcataaaagcctctacgtgcactgctgtcgttatttttttctttgaaaacggaggcaaaaatacttcagctttgatgccttatgaaaagagaaaatcgtgacatcttcttaatatgaaaaactagacaaggttgttaatatttaattgtctaagccagatgcagtaacacatgcgaatgtgttcataagtttggaacaggggatgcatttgatttactcttctacaactttccaagtgtattttcattattttacagaagctcatataaataactgataaaatcgacttgttaaaaaattaattggatttgtaatataaagaattctttttacccatagtaatatttgttcgttatagattttatctttaatttttaaacttctgttattttgaacctggtgaggtctacttggttgaactattaatgaaccacatgccaactaaagttgatgtgattctttcataaatcagtatatgcatttataatgcacatcaattttttttctagaagatactatgtgtgaaaatgtattaatttaaaagaattagttaacttcaaagagatgccttggaaattttatcttaaaaattaaaaaagaaaagaaaataaataactgagcttcagacaatttatgctcagtcctcagaacataagctctaaaccatataaaactttatttggtcagttgctcaaaatagtatcaaatgggaccatcttcccaaccagactttcttctcttctcttgcaaaacttctcttctcatgtcattttcaagaacttgctttatgaataccttttcttgtactttctgagagtatcagattgcaaatacatatccatacatgtatgcatatatgcaaacatacacacacatgcacacacacataaaacttctctagggtaattttcagatggcaaaacaaagcaactcttcctctgctcttcactctatacataattttttaaaatgtgttattcctgcaatagtagttaaaaagaaaatagtatatatcgacctgaaagtgtatctccccagctcacagaggggtcttatttcactatgataaaaacaaaattaaggttatagttaataggtgaaagcaaagatcttaatcaggatgagttcaaaatgctaaagaaatgggtattgtgtaggaaatgggaaaagtttgaactgatagtgtgggctctccagtgctgttgacatgggcatatcatttttgtccaggttaaaagaatatttaaatattcttttaatgcaaaatgcaaaaaatgcatttgctgctaaagtaatgtattatttaacatagctgaataaatccagttcaatcatttgagaagtgcacataataaaataatgcttcagcctaatcaatctaaggcttttatttactctagatctatacttcatacgcttaggaggaaggttttttgctctaaaaattaggcgcaagtaaaatttttcctaaagtatgaaatagggatctaaatttgggcctcacaggccagcattacaattataatatatgtgatgaattaatgtgattaatttataattgatttagataaaaacaagctttaaatatgggattcctaatacaaatgtacagtattcacattttactaaggaaagaggctgttcttacagcccctttgaaagaggccgttcctacagcccctttgaaagaggcctttcatgagacgatatatgacgtgaatattgttattatttattttggtcttcttacgtcagcatttcagctatcctttatagttgctttgatatatgtttcttctatcagtttgtgtaaagaagccatccctccatgacctttgtatgaatatgagtgtccttttctgttggggatagaagctgagaccacagatttctttgcacagcaactcagatcactagtccatgaagttagaatggaggagaaattactggcaggaaactcagaagtctgcctttagcaaggaggaagaggaagctcagcttctccctcttggcaccatttctgttagtctgagacctgtaatgtgtggttagaggtggtaaaacccaatgggtagatgctctttaggcttgagtaatatagaactcttgaataattggaagaaatgaaagtagagttctttcaagtaggaacacaaagctatttacctagagcaatggttcccagagtgcagtcctcagatcggcatcttctacatcaacctgatcttcttagaagtgcaaaattttcagccccactccaagcccagtgcatgagaaactccaggtatgggacccagcaatttgttttggtaaactctccaggtgattctgatgcatacttatatttgaaaatcatattctttagagggtcagtagcctcttttctgctgcctctttcagctaaagagcattcagcctcttaagctcagtttcatttcctttctcctcgaaagcgaattgtttccttgacaggtaggtagtttagatttttgaaatgcagaattgagagaaaggggaagagaattggatcagaactgagagagaaattttctcaagagcttggagaagatcagcgctggaagaagagtttcaggtaggggaaaatagacatgtagccatcgagtctgaagtcatctggggtttgaatcttggttctgccacttagatgatgcagggctttggtccacttatggggcttctctaggactcagtttcctcatatgtacaatggagataaaacaacagtaatttcctcaaaggcgtgttaggaggttcaattagttaatgtattatatggagtatgacacgatgttcaatatccattaggtatcattgctggatgaagtatattctattaattgtgttcagaaaaaagggagcaacgaatcacagtgatttgaactttactttttgattgctggactggttactttgcttaaaaaaatgctttctgagaacagaccacatgggtcacagcttcaagaaaatttcaaaaggaatatatttttccaagtagagcaatgttaaaagacattcagaatccaagacaaataaaatgctctgttattacaaagctattgtaggtcctcagttatcattctctctgctccaactctttgaaaagctcttcccaaaacagagggacacaagttctttgtcccctgttccctcatgagcaaactgaaggcttctttgcctcctagtatatgggtcttttatttctaaaactgacttcttaaagatgtcaactagctttcttgtgtgcaggtcttaaaacatgattccttcagcactggattgaatatccagtgaagatttctgtaataactttctaagttctttttttcctctatcatagagttccattggccaataagaagagcattttgactcaccaacatagatttttatttttgacctcttcactctattaatggcaaatagtaaaagattacatagtgtggtggaaacagcaagatatttggagccagacaaggtagttctgactcaacctctaattagctttttgacttaggaaagtcatttatcttcttggatcaattttctcacttagttcagctttcaactaggacaatagaaccttacagggatgaagagacaatcaagtgggggaaaaatgattttttttaaaaaaaaactgcaaagtgccattcaaatgttagctattgagagttaatgataattaacattcactgagtgtggatgaagagctgggcaccatggaaagtctcatatatacatatctatatttatttacaaatagatataagattattgcaatgtatattatgttcaatttgttaaatttacacagctagtaaataaaacttagaaaatgtaattttcttagctcatgtttaaacatttaaacctcgattagaaacatgatcagctttggtctgaaaataagagaaaactctgacacaatctgatgaaaccaataaggatacttgctatcgctcataacgtgaagttcagagagacagtggacgccagagtgtctttaaccatattcttatagttaccatcttttatgacaatcatcacagtaggctgtgttagaaatttctaaagctgggaaaggcttcagcagtcagagtctagactgttttcttacagcagggaaaatcaagattggagtttcaaggagctaactcatgatagcaccaggggatggtcccttcatccaatccctgattggaaaacaaccctaggccatgacagtggcagggacttagtttgcttagtgacttgctctttataatttctagataaatctgcattttgcttcactcttctctcatcagagaggttgagttcttcaaacacttttgttgttatttctcaattcaaagagcaacataagaaagacatgctcttactaggtcattccaaggtttttttttccatctattatatgtaatcagatttgtatctctgttgtagaaagtcttatttttctttatgtctgttaaaataccagtaggttctctattctgctaatgtaatatttcttttttttgctgttcctttgagctggggcacattttattgttttgtgttaattctgtgattttaagtctgtatatcaaaattgtagtcctactaggcatgtaaatattataataaatacattagtaatgcagacagcctacaaaatagtttgctagtttgctctaaagatatttctggctgtgataatgattaatttcagataccctgcatcataattttcttgaaatatgtaaattacttccctctcaaaatttcttatgtagaaacacacacacgcacagacacacatacacacacatatttagcaggtcgaaatgaggttcttgaatctgcacaaaagttgttgatgccaagcccaaacagtacaattgtgagtgcagctggtcaggtcttcaataccgttcccttctcctcaccattcttcatgcccaaggggtctatttgcatttcctagaacatgccttgcgctttctagccttcagaccttttctcccagtttgtccttcacttaggatgtcttcttttagtatctccaactaaatgaaccccaccctttcaccaatagggttgaaaatacattttctcaatatctcagacaatcccaggccagacaaaaccccaagggccagttatcttttgcatttcttgagcactggttgagcatcgtgttagtaaaattaaatgttaatctcaaacacagagtttgagaggaaggcattcctgttttgcaagtcattgtaatttcccccgcaggtagcactgtgcttttagatgaagctcagtaggtggaggcttaataaactgttttttggattgatggtatgattagaagtaagaagacaattttggcttaactaagagaaaattacaaactagaattaattgtgtgttttaaccaaaaaaaaaaaagaaaaaaaaaggtgtggaattgatcttttgtttactgtaaacatgttttccttttaaaacctttcacagagactgagtaattttgtgctatctctttgacccatcttttgcctgcaccctctcatctctttctgcatcaccctcatgaggggccaagctttctttttaggttgctctcttccttttcaatgtgtttatgtatttttcttcttagaagttttgggaagaattcagttacatttcaaaagtcttgctcttcagaattaaacctttagccctgtgccttttgattggctctaaaagtgcgtgtgtggcctgcggggacagttgtcagcgtggcatctttcttccagtgtgcccctctcctgcccttaagcattccatttttccttttaaccgtaacactgttgctttaagttgattttcaacaggtcttttgactttgatgatttcccaagatattgcatgtgtgaggtgaggagggtgtatgcggacttgttctttcctgggttagtgactagcctgagagagtttaaggagctaaacacaactatttccttgagtatgagaattatgattgaatatagctctatttttctccacccttgtctttgacatagtcttctcactttctgcatctttctgaaacatctataatagttttgaccctgaactttattctcttaaccagtcctatcaatattgtaccgttttgaagttaggaggtcataaagccattaactaatttggaagattcatcaatggctttgaagagctttacaaaatatgctgagtattctcaaaaatcaaatcagatcaagttagaattttaagaatttattgggcatataaagaacagtttgtgttttgttttgtttgttcggttggttttgattttttttcctggagaaaggttagtggctcccagagagtctagggcaaaaggctagtagggcctgatctaggaaagacttcttgacatttacttgagaggggcatgcaaaggtaaatcaaaccatttttttacacagttttagggctacttagtttttcttttaagattttctttaaacgtctgcataaaggttttatttatgttttaattgactaataaaaattacatatatttgttgtttacaatatgatgtcttgaaatatctttacattgtagaatgggttaatcaagctaaggaatgcatacattaccacacatacttatttattatggtgagaacacttaaaatttactctcaactttcaagaatacaacatattgttagtaactatagtcaccatgttgtaatgtacaataggtcaaaaaaaaagagaacagttcatgaattgggagactttgacatggaaacatgacatgagtctcaatattacaacaattacagtacagcttgtagaacatatagaaggaaggattttgatcttttttcatgattggttatatcatttttgaaggccattagggctgtttaagctcatttctctgtagctgtattggtttagttacactgaatcatgttagtaaaggactaaaagcttacgtttgtgttttgtttacatttcacgttagcctttcagggaaatcaggatgatataagttttggttacttgactataggcagttggccttggggtaggtaaatggtggccttcatttttatttatttatttattaacagtaccctctctttttcaggtgagctaaactatttatccaagcaatgcttatttctccctatctgcctctctcttctcttctcctcgctaaacacagacacaaaccccaattagactgtaatattacggtatagttttgattctacccatcgtgacttatgagacattgcttaaatacacgctcttattttttattcatccaaatctcctcatccagcttttcacccatgtttttcttcatatgctgatgaattcctttcccagagaatctagccaattcttttgaggctggctgctagctccctccccaaggcctccacttcaaagtgccctgctgccatagcggaaccaccaacaatctttttcaaaacaacctggatttttttttttctccttaggtctgggtatcaatcagacacagaggagctgatgagaactggtaacctaaaacaggatgctaagaagcatcactgacatttatctgggccttaatgtgtggcaggaatttttctaaggacttttccttatgtgatttcatttaatcatctgaataactccataaagtattattattattatcctcatttttcagatgaagaaacaggcctaggggggtaagttacttgcctaacgtcttttagtacaagatggggcttggattatgaacacagaggatcagcctccagaatttcagttcttaagcactctgccaaatggtgcattatacaagtaggtacacacccctattttcaaaccttgactggaaacacaagcattatggttcattttaaaatacaatgttaacttttcagtttataagcatgatgttcacaatttagatgatacactttggaatggtacactctgtatatttgggacatttcatttggcagccactgaagcttgttaatatcaacaactggcttcattggctccttcaaataaacccgtttaatctattatagctggcctctagcaaatatgccataagtagaaataaattttgagttaaagaatattcaccgtgattagaagctcaaaagaagtattttaaatgtgtgtgtctgtatttgggtatgtataaatagataggtagatagacagatgggtacatgatagatacctttgaaaacctttttcagttatgaaagcatttagtatatagtgttaatagaattttatctatcataggttaggtgtattctgatgttcagtttatgtttttaaaataatttggcagaaataaaagtattgacaggtggattgccactttggcaattttcactctaagacatcaatcgacaaagcaccaaacagcaaaacatattactcattgactggtaagtcataagccccagaggctgttgatcatcctggatgctggatgcttgcctactgtaggacagatggaagaactggctgctaaatcgtttctagcacttgacgcccagcatgattggggatcctgagcactgctggaaaaatatttctctagtaacttatcttgtgcttatcagtgaatttgcaagcccaagagagatctgttttgttgagatggcttctgaacaagtcaaactcatgtttccaagccaatttctaatactacacttgttattggatattacttgaaccagtttctgtttatggaacacttagaaaatttaattggaaatattcattttgtgattcaaagattatttattgtacttttgctggaaaggctgaaggtaaaagtatggctacatatcatttggcctgattttatgattcaaaaccaaaaaaagaatatgtcctgtaatatcttttccattgcaatgtagttttaataatgctgcagtgagtggattattgaccaacatttcctagtcctggagccacagagagaaataagtcatgtaggaaagccagcatggcctcactggctcccattatcttgattagtaaggtaggattgagggttaggttttctttcttttatttttcaccaggccccaatatgtgctttttcgtcctttgtcaacttttctttttcttttttctttctttctttctttcttttttttttttttttttttttttttgagatggagtctggctctgtcacccaggctggagtgcagtggcatgatctcggctcactgcaacctctgcctcccaggttcaagcaattctctgcctcagcctcctgagtagctggcattacaggtgcccaccaccacgcctggctaatttttgtatttttagtagagatggggtttcaccatcttggccaggctggtcttgaactcctgacctcatgatccatccgcctcggactcccaaagtcctgagattacaggcgtggaccactgcgcccagctgtcaacttttctttttaactctcctttgaatagacctaacccacattgttgtgttgaattttgatgatcaacagtactctgctcgggcttcctggatccagagccctgcaagagataaagtagcaacaggtaattacttggtgaacaggagatattgaaattgaatcaaatgtcctagagctctttccgccagactaacctatccccagcttactatggaacacacatagactttggcttttagcacccttccgatgcagtgcctttcttccctgattgcactgtataaaagctacaaatcatgcttctctgtctacactccaccccgcaaacacacacttttttttttttgccctccatgcttactattctccttctgttcacatggtctttcttcaaaatacagttatttatttatatatggtaaattttttgtaaagatagggtctcattatgttgcccaggctggtctcaaactcctgggctcaagcaatcctcctgccttggcctcccaaaaagcataaaattattttgaatagagagttgggaatgaaaggaattcttggattttaagtttatagtatttgggcttcttctataaatagctgatcccatatattatggaaagagaggttacttgttttattctgtaatgatgcatagacgaacaccacaccggacccatttcacaaagcacgtcctgcaaaaaccctcacatccacactcattcatattttctttggtacataaaacggttagaaagtattgacaagtagttttcacattttgattatgtgatttgctctttgtaacttttttttattattgctcacaaaataattaaacacattcctattcatgcagacaccattatcaattcatgttagattaaataattttaaaattaattaacttattaacaaaataatattatagtatcttatgaattgcctagatatggcattgttttgataagccaaagactaccccatgataacatgtatttaggagcaaccaagagaagaatataggaagtctccagagaattctatatacttgggcttaactatggtcaaagtattgccctgaggccacttttaaagcacatttctgattcaaataatggttttgacatatgttaaggaaaatgttggcaacaaatctagagatgaattgaagacttattcactttacaaaaatatttcttcaacatgcaaaagcatacacctctggaagtctatatttcagctttccctagtattgactagtagattcttactgagaaaaaaaatgaaagaagtaaaagtagatacatttaaaattaaggcattaagactatgcatggtggctcatgcctgtaatcccagctattaaggaagccaaggagagagaatggcttgaggccaggagttcaagaccagcctagacaacatggcaacaacctgtctctacaaaaattttttaaaaaattagctaggtgcggtggtgtgcacttgtaatcttacctatttgggaagctgaggcaggagaataatttaagcctaggagtttgaggctgcagtgagctttgatcacaccactgtacttcagcctgggcaacaaagcgagaccctgcccctgaaaaaaacccagtaataggaaaaaaaatacaattaaggcatcaaaagtgattgatagtttaacatgcctttaacctaaaagtaaaaaatctattacattataatgtaaatcaatagaaacatgtcatataatttacaaaatgttggtgaacatacacccttttgagacacatgttttctgcagatcaacgcaagttgcacaggtataactactgacaaatggcctccagaagttagagcaggcattgttaatttagggctatatgggttccaagagtcccagccaatgtcagactaggatcggtcaactcctggagttacgacttggcttgtattttgacattttttgtgttcattagttggaggatttgggtggcagtaggaatggaatctctagggtcagcatccctgtagtaggaatttgagtctgaaggaatccttgaatggatatcagtggatctataaaaactttaaaatcacggacaaaaatgtatgggatggggacaagccaataatatggtttaaatatttctaatcttttattttctggtcagggaaggtcttttattagcttctgttagattacgaccaaggatactcgattgaattgcaaataccagaggactaaattactgtaatatagtaaaaatgtgacttaaaacattaaatggattaaggagaaagcaagaaaagagtgaaagtggggaggggagttttcggaggggtggaacttcattggtggtacgggaatatatgtgaccttattatggaaatattctctatcacacacccaccttgaatctgtgtgaagagcagagggcgctttgctttactattatcttttttgctgtgcgatttccaccgtatcacttaatatcttccagttgtttcttcatttgtgttccttgtgttttgctactgacctcccttggagggatgttgtaaggcataaatcattaatgattataaagtgctttggaaatagaaagtattgcttcagtgatagcccagatgcacctaggaattgcagcatgaacagtacaaagcaaaaggcatgttgtcagaattccttttggggctccggatcagccaggccttccgctcacatcagggtgaattagggccatgaatctgaaagtacatctgatactgcttggcttgtacgtgctcttgttacaacattattttgacattttttgtgttcatttgttggaggactttaaacccttttctaaccaaaggaaaccaaagtgcctactgcaagcatttttcaaagatggtgtcactctgattgaggataaaaaattgatctactaaataaaaatgttggaatggcatgtttatcttacttgtttggccagatataagtaaggcagtgattcagaagaaggcttcattagaatgcaccatttatctaatactttgacagtcagtgatatcttctctctccctctgctgtctctctttatgaaaccaaacactgacctgtctttagcctacaatatcagatacaagaaaacagagaccaatggaagtaaataatccatcaagttagtgttaaagataagactagaaactgggtgtttcatctcccagttcagtacttctatatatctgagtattctttgatcatttctaagaagataccaagcagctttaatcaaacattcatccttcctaaaaggacctgagatttttattcaaagattccagaataccagttattcataaagctgcctgtccatgcatttagagtgtgatagagatcaactgtaacatccgtcatgttactacactccaagattgatttctgtggtctacttggtttgatggaaagtcccttcttcccttacagtctacatatctcctttaaatatgacttttatagatcgaggtgaatacatgattaactacattttcctcctattcatttatctatgtatagaaaaatgtgagaaaggagcaggaatctaaataaactcctaaattttcagtcgttgaggtatgcacagttcaaaagagatacttgtagactaaattatccagatgatagtaaaaattccctattttacattccagatgcagatccagcctcagtgatgaatacctaaatataattcccagtccttttatttcttatctttctccccaaggaacaggctcttcctcctactttggaggctcttctctctaatcgttttactagttcatgctcttttctccttggtactgtccaatctatatactctgttagattagaccatcccaactgagaaagcacagtgggatggagaagggagaaggcatggttcatttttgtatggacagttctgagtgattggtagggccagaaaaagctcttctgtgctacaggcttagggacaaacaaacactatgattgttaaaagatgttaaatagagcaatcaggggtttgaccgctcaaatgtagctgcaaccaggaccaatttgatgtgagctctgaggcccagtttttttcgtatagaaacaattatttttttttatgttctcccagagaacatcagccttgaaaacctgtttgtgctaaccagactcacagaggactgatttctgaatgtgagtgccactttattcaactgtaatgccactaatctagttttgcagccaccatggccctgccttttcacactttcttggtgttaatggatccaagatgtagaattagtgactagaagataagtagccatagaaaaagaattggaacagttagtgagttattcaatctgacctgtaatagagcctagaaaattattcctattcctctctgattgcccccttatgtcttagttggtcaggctgctgtaacaaactaccatgaactgagtggcttatgaacaacagaaatgtattcatcacagttccagaggctggaagcctgagattagggtgctggcgtggttgaactctggtgagagctcttttctgagttgcagactgctctcttgtatcatcacaaagtggagaacagagggatggagagctttctctggggtctcttttataagaacattaattaatgagagctctatccttatggccttgtctaatcttgattaccgccgaaagggcccgccttctaatgccatcacgttaggggaagggtttcaacatatgaattttgggatgacatagttatttaggctgtaacaccttataattaactgaaccatgtgtgttcattcatttaatatgggtttactatacttctcttatgtgccaattactgtcctaggttcttgtatttatcagtgaacaaaatagacaatgatctctgattttaattgtctgtatccagcagcccatgctgtaagagtattagaatattagttccattagggataggaccagcataatggatattgggcacactcctgttagtttcatgaatgaatcaaggctggctcctactggccaaatctgtgccctttgacatttcatttccaggctgtatatcagtgctattcaatagattattcagtgataatggaaatagtctctgtgctgtccaatatggtagccactggaaatatgtggctttgagaactttaaatgtggctaacgcgactgaggaattacattttaaactttacttaactttaattaattgaaatgtaaattgaattagctacacagagctagtggccattgtactggaaggtgcagtcctggctgatccacagcgccccagtgtctctgtgagattagagactgctgcttttgaaaagttgctgctcagaagacagtgcaatggaccattctggttgtttaggcatccagaaaccagactgttcctatgtcaatgagtaggagcacttgcttataataaataggaagttgcatagccaagtagggagacctagattcctggagatgatgtcaataggtggccacttatgcagatgtttactacttaggagatcttcaagggctcctaatgggatttcagctgtttgggaggtctgaaaagatgccatacataatcagaggtcacgaggcctggcctaaggtaaaaattttttttttttttaaacaggccacagtgcagtggcataatcatagcttgctcactgcatcctcaaacttctgggctcaagcaatcctccagcctcagccacccaaagtgctgaaattataggcatgaaccaaaaggtagatatctttaaacactaggttgggttttgggagcagaattcctgttcctggaaagactgttaagaaggaggcaagaccctcatctttgagaaattgtgacggggtggattttgagccctgggaacccatgcaggcaacttcccagagactagaactgagggatcaggaaagaggaagatttccagataaaggaacttattctcaaaagtatacagtgaacagcagcgaagttcacatattgttgagtccagtgagctgaactaggctctttccattcttcgttcatagagctggctgggctgggacctgggaatcagattgttccatctgttgccagggaaggaatgtgtgtgccgggggaaggaggaggtcacaatgtgttctctttgtgtttttagcaatttggtgtttctccttaaggatatttagcagaaggacatcatttcttgaaaaacactgcaatataaaacatgttataaatcctatcaaggtagcttataccttcagaggttaataggttaattctctccgtttacgatgactgtcctaagctttagttccttgacaccaaccacggtgaagtccagcagagatggaaacctgtagtgtgctgagtcaggagattccaatgggagtatatttagtctgaaatctctggggctgaaaatttaacattcaaagcaagtaggcaaagctggcttgggtagctgagtgcatggtcaggtgctagagagaaaagcagagattcagtttaggagaaccctgagaagttcattccagttctttccttgctgccttcacaactttttattggaccagttctatgccaggtgactctgtactgagtcattgtaaagtctttcaaggctacaggtaatttggaacttgcagctctctacatacttcaaattatttctcaaaaatctttagacttaaatgagttctttttctcaatctaccatttatatagccttattgtccaagatctttaatgacccttggcttgagtaccttcacatagcaaaggattctgctggagtatatgagttccaaggtatttttttctgatgaaaaatatctatcttggtttttacttattagaaatggaaatgtaagcactttgtactcactatataggccactggataatcaccaggttggtgcaggtgtgagggtgagtgtcagaaccccagagaactggttatgttttgaggatccatattcaggaacatataaatttatattgggaaaatgtaaatcaaaccacttgtactgaatgcttgactacactttcccatggtacacatcatcatttccttttaagacatgatcactccacttaaaattgtaagccattccttcatgtagtggcattccctgcctctcttctctgttttctccaagttttaatcacttataatataatatgatataatgtaatacagtataatataaaattcacttctttttaaaaaattgtcttatcactctttattaaaatgcagtctccatgcagaaagggatttttgttttttccactagtacatcttctaacttcaactgcttctgacacatagtgggcacacaataattaagtgttgaatgaaagaatgaataagtgagtgaatgaattttttggctgataggaatatacaacatatagattccaagacatgaaccttgtagatggcaccctgtatgagaatttctcaggattttccttgcaagtatgtcaaagactacaacgtactcaccaaccccatttcgccttccttctgggcatccaaccacacaatctttccatctacctctacatttgatgacactatgtgatagtgttctggccaattacatgtggatgcaagtgatggttgccacatcctggcctgaccatgagaacctgactccatggtccaccatgcttctcctctcctattaggcttgaatgaagctgagacccagggcatacttacatctctgtgatgaaggtggccaagtgcacaagaaggaaggttctgagtccctgggaagaaccatccaaccaggagcgctgccccctgccttgacacacacaattgagttttagcattagcattgttgtaataatgcaagaggtaaacttgtactgtattaagcctctgaaatttgaggtttgatcttttctagcagcaattaatgtttccttaacctccagcatgaaattttcatgttgattaaaagaagaaatcaagttttggaaaaaacactgctaaagaatatgagtgtgtatattagtctgttctcatgctgctaataaagacgtactcaaaactgggtaatttataaaggaaagaggtttaattgactcacagttccacatggctggggaggcctcacaatcatggcggaaggcaaaggaggagcaaaatcacatcttacatggtgggaagcaagagagagcttgtgcagggaaactcccttttataaaaccataagatctcgtgagacttattcattatcacgagaacagcacaggaaagacctgcccccgtgtttcagttaccttccaccaggtaggtaattgaattcccactacatgtgggaattatgggagctacaattcaagataagatttgggcggggtcacagccaaacaatatcattgtgttaccgaaataatctcagtgccctggtcacagcccattgtgtcagtttaaggaaaaaaagaattaactttaaaatacagagaaaaaaacattctgctttttctaatcagttaactgacatgctttcatttttatttttttaatgggttaatttccttcacaggacagaagcattaggctctggagaattttagcatgcacccagataatttcttttttaacttggccttcatattgctttcagaaaccacccagtgcgttgtgttataggaatgttttaaactcatggaatgttcgtgtcaactctttcaaatcaagtgtgccctcaagagagaaccaaaaatcataatcttttttcagtgtatttgctagaaatgtatcctttttcattcatctgctggagttttttatatttctctttgatataagtagtgtaacctgtgggccatgtgttattacctaggtaagctggcacactgtttttgtggggacactaatcttttacagttttttctctcccattagtttgaaatttgtagttctagcaatatctttcttggaacacacattaaggaaaattatgggccaggcgtggtggctcacgcctgtaatcccaggactttgggaggccaaggtgggtggatcacgaggtcaggagtttgagaacaccctgaccaacatggtgaaaccccatctacactaaaaataaaaaaaattagctgggcatgggggcacactcctgtaatcccagctactcaggaggctaaggcaggagaatcgcttgaacctgggaggcggaggttgcagtgagctgagatcgcaccattgcactccatcctggatgacagagaaaaactcagtctcaaaaaaaaaaaaaacacaccacgaaaaattatggtgaaataatggatcttaattatggagaatggaagggtcacagtagagaaactttcgaagaatctgttttcttcccctggaggtttcttttggggggacctcatcttggctggagcgagatgttataaggcagtgtccattcccctgcagccactcccaccctcttccatcctgaagcagtgttctcattgctgatagatgaaagaaaactgggacctccttgtccataaacttgaagtgagtctaaacgtgtaagattttcagcctgggtttcaaaaatgcatgtgaagaaaagtctagtgaacctgactgtggttaacttggagatttaattacctgagagaagagagagagtgaatacctttggctgccagaggcttggtacgccttgcttttggcatttgttttttcgtcattatagctttggttgctagtcttcaataaggctgcagtgatcataatgataatgttgttcacaggcaccctgtaagacctcatttacataggctaatagggctggagaagctcaagcaaaaattaataatgattaactgtgtttttatttgactttcaattgtgattttcttttttaattgccgatgcacttccataaatagagtcaacttttagttctcacctgagtgtaggtaaatgggaggaagtggtgagtggaaggggaaagccaaattgatattaaatattcccataacctttaatcacaaatgcaaattcgtgtttactcagatagggaattgaaagttcttgatgtcatatgggatcacgtattaggatttgagcattatgcagagtaatttgaatttgtattcatcaaaatactgtgaactaaatatatttaattgtatattattccagaaaccttcattttaaatctgtaggtacctaaggacaacatgttaaaatattcttgcattatgataaaaaatggtattctaggaatttctaaatagttttcattgaagcaacttagacttattactgattcttgatatcacagaaaaattaatgtgtataatagttgagattattattctttacatttctcccttgaactaattaactggtaacttaatttttcttctcctatcctctccatacattgaattccagaaatttataataatagcaaaacaaaaacaaaaacaaaaaaacctcatctgtaacatgagtaccatctagaataatgaaagaaattttacctgtatgatttaagtatttgccttcttgtaaatattattatggaaagtgttaacagaaatgatttctgatgtctaagcaaggactggttttctactttttcaccttgtagggtgggggtgggggcagtggtacaggggaagatgttaataagttagggttaagcaactcttttacagttacactatgacacaagagggcacaacaacacccctaaatctctaaggctggttgttgccataggctggagagcagagaggaaaaataactagttttagagacagataaactggagtttgaattccattttggcatttgcaagctatatgattgtgtgaaaattagttaccctttataacctttattgtattcatttgtataatagaaaaaaatattttaccagattgatgtgaatattaaatgaatgagaatttccagttgtctacctctgtgtgttgttacatatcaattccatgagagtaacacaacctgactccacaggaaagaacagtggaaacctcctgtttgagatctcccaggctcctccctatgcatcacttcaatgggttgagtttgatcagtgtcctttccctctaaaaagtcatagctgtgaggatagtagctttcagtgagctccgtgagtcctactagcaaattatcaacctgaaggtgtttttggggacccctcttcccaaacatgcagttggtattagaagtgaggaccttcttggagaatgtgcccacaaacatggctatctggctaacttttagcacaaatgaaaaccaaggttcttcactgtaccctctactaggcatgccaaacatttttttaggccaattccacagacttttcttggagaaacttgccaaaggtttagaagggactaataatctcaaataacatgtggcttcagaaccctgatacatctggtacaaacaggtggaagacattttagtgcagtgaaaatggtctaatgtgatttggaatataggcacagagaaaaagagactctgttagttggtgttgggtgcttaaattaggagatcatctggccttgaagctgaagctcaaactgaggcagccataatggtccatgtgcagcagagtgtagaaacagagaacatgaagaagaaaagcaacttgaagggagaaacagaaccagaagccaaggcttggcaggatgagagcagtgcagaattgatcactttacaggacttgcaagacccattatttctccctgtgtttccttatcataattttcctctgtctcttccaaacaccctgtacctaagcataagtgtgagggttttctcatttcttgtaatcaagagagtgttaatgaagacattctgaatgaggcttatgtgatttaaaaattgctacaaaagagaatgtgttaatatttatattcaaattgctaaaacacgtatcaaaatatctatatatatattccaaagatatcagaaataatttagaatgggggattcttttttcttaagtgaaaaatttaacttcagaagtatttaaaagaatgtaagaaatgcatagtaatacagcaagaatatgccattttacatatttttaaataatacattgcattgaaatactggtaatatcctttgttaaagaggttgtggtaaaaacataactctcaggatacaaaatcaatgtgcaaaaatcacaagcattcttatacaccaataagagacaaacagagagccaaatcatgagtgaactcccagtcacagttgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctgagccagaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgacaaaaacaagaaatggcgaaaggattccctatttaataaatggtgctggcaaaactggctagccatatgtagaaagctgaaactggatcccttccttacaccttatacaaaaattaattccagatggattaaagacttaaatgttagacctaaaaccataaaaaccctggaagaaaacctaggcaataccattcaggacataggcatgggcaaggacttcttgtctaaaacaccaaaagcaatggcaacaaaagccaaaattgacaaatgggatctaattaaactaaagagcttctgcacagcaaaagaaactagcatcacagtgaacaggcaacctacaaaatgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgacaaaatgctcatcatcactggccatcagagaaatgcaaatcaaaaccacaatgagatatcatctcacaccagttataatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacgtggatgaagctggaaaccatcattctcagcaaactatcgcaaggacaaaaaaccaaacaccacacgttctcactcttaggtgggaattgaacaatgagaacacatggacacaggaaggggaacatcacacaccggggcctgttgtggggtgggggtagcggggagggatagcattaggagatatacctaatgttaaatgatgagttaatgggtgcagtacaccaacatggcacatgtatacatatgtaacaaacctgcacattgtgcacatgtaccctaaaacttaaagtataataaacaaaatacactcattcagtattggagattgtaatatgacactattcttttggaaaacaatttgacaacatgttttaagctgtaaataaaattatatctatcggcccagtaatcccactcctaggaacttaaatgtaaattttaaaaaagaaaaagttttaggcataaagacatacaatttaaatacaaaaatatgaagctactttattctcagaagggactagaggaataagttactttcactgaaattgatggattattatgcagccattacatgagaattattaagattatgtagcaacaagaaaaattgcttatattcatgacacaaaatgaaaaataatggagaatataaagttgtatctgtaccatgatagaactacatagtaatatgtactagtactaatttatcaattgtgcactagttttgtactttaggtgcatgatttactcaagtttcacaaccacactaacaggtgacactaatattattccattttacaaatgagaaatttagacacagacagtttaagtgacctgaagtttcatagttgggactgatgttctgtttcaacccaactgatctaatgccaactggagtactataatacaattctgatgcattaacccactggagttgacatcagactccacaagttaaaggctcagtcatccgcaagactctctttaattcagatgccatttgtactttgccatctgtacttgagcctgggaaggccacttgcacttataaccaactggctataaatatcgaggttcccacaaccccctcatgtatgttaatttggtagatcaactcagataattgctacacctataattacagtttattataaaaaatacagatgagaaacagccaaatgaagagacatacaggataaggttgggtggagggaccaagagcttccatgccctctccttgtaaaatctgggtgcatcttcccagcacatcaatgcatacaccacctggaaagctccaatgaaccttagtgtccataatttttattgaggtttcattacatagacaagattgattaaataattggccacatgattaaactcaatctctagtccttgccccttcttggagattaggctggtccaaagtttcaactctttaatcatgtggttggccttcctggtgaccagtcccctgaaataatctagcagctcagcatgagtgactttatcattaataataacaaagacaatactatcacttacgaaattccaagggcttcaaaagtttcaagccaagaactggggacaaataccatttatattctctattataccacaagtccctttcaggaattaggaaaatttattttttattcttgtgcaagcattaggcccctataaaataattatgatctaataaacaaacaaacaaacaaaaacactgggttctaactctgttctaacctttccaagctctagttctagtaatttacaagcactggtgttctcaccttcctgggctcagacttttcttctgtaatgactccttaaatgatattaggtgttgcttcaacttcctatcttccatcactcttggttttttttttctttgagcatggcttacattataattggatttagcccagatatcaggagtcactgggttcaaaccttatcttcatcatttgtaacctttgtgatcttgagccagttacttaacctcttggtgcctcagttttctcatttgtaaaaatgtgagaataatagtgcttccttcacagtattgctgagagaataagatgtaattatgcaggtaaagactttatcacttattctggcataagtatagtaaggactcaataaatgttctcaaaagtaatttataatgtatcaaaattttataggattttaagtcaaatctctccagtataaaagttgaatatatcaagggtctatagaacttcattcttgataaaaataccaggcatattaacaatgacctataatttaaacaatagccaggtgtgatggctcatgtccgtaatcccaacactttgggaggctgaggtgggcagatcacttgaggtcaggagttttgagaccagcctgaccaatatggctaaactctgtctctactgaaagtacaaaaattagctgggcatgatggtgtacacctgtaatcccagctcctcaggaggctgaggcatgagaatcacttgaacctgggaggcagagattgtagtgagctgcgactgcaccactgcactccaacctgggccaaaaagcgagactatctcaaaaaaaatttttactgtaaatacatatatacaaaattttcagtaggaaaataatgataatttgtcctgtagccaaatactgttaattcaggttacctaagtttctgtgaagaagaacatgttatggatgtttttgctgtcatgaaagtattacaaactgaattcagaatataacaaacttacttttgtatataggtcagaaaaggataacttggaaaatcccttatatgaacctttatatgaatagaaagaagatctgagctagtgactatccaattagtctagatgcacatgtgtacctacttaatgaaaccatctcatcaaagagtaaaaaaaaaagtagatttgtcttagaacaattctagttttatcgttatccagccatgagactttgacttctgtaacaaacaagttagaaataacagctaacataaaatatgtgacttgtgactaagtgagaaagattatactatatgatgctatccttaaaattcaattatttctttttttctatttgcttgactgtatgctataaatacaattaaaagtttgtcttaaaattcaattttttaaaaataaccaagagaacaagaatatggtagctttaatagaaatttcatttaaagcattccttttgctttttgaaattttgacctaaaacaaccagtgttcctattgtggcaggtacacaatttttaaatttttcttcacttgtgtctatgagatattaacagtatttataatatagaaataatcatcataaatataatatgaccaatatccagataattaataataattcctacacacattacatgtttatccagtacatataaggtacactatctttgtacttttatttcttcttatccacgtttcttagaatgtaatacatacaacacttggataaacatagcagtaatcctaataagcctaaacacaatatttttctgatgttgagataagttgatctatcaaggtaaaaatgatgaccacattcttactgttcattcattctttttttttttttttttttttttttcaagacagagtcttgctgtgtcgcccaggctggagtgcagtggcgcgatctcagcttactgcaagctccgcctcccgggttcatgccattctcctgcctcagcctcccgattagctgggactacaggaacccaccaccacgcccggctaattttttttgtatttttagtagagacggggtttcaccgtgttagccaggatggtctctatctcctgaccgcgtgatccgcccgctttggcctcccaaagtgctgggattacaggggtgagccaccgcgcccggccctcagtcattttttcttgtgttcattcagctaattcaaaatgagtgctccaccttcatgattttggacaaagcagaatattagttctgtgagaagttactgagcatagagattaccagttggtaggagagataagtagtatatttacacggctctaatcaaagatagaatgcattaaaagatgtaagtacaaagtgttgtaggaatttgaacatgaaggagacttagggggcttaagtgattagtaaagatatctcaattattgaatgactgacaagggagtttttaagtgacattctagaataatcctaactgttcctggacaagtgttttatcaattttttttttaagtttttaacgttttataacattaatacttgatcaacaaataaatatattgtcaatctctccaaatttaatggccaataaggaaagaaaatgcttaacagttagttatcattttgttcatataattatatatattcttctgcaagagatgctaattacttaaaagttatcttagcttgggcttctaaaacaaaatactacagactgggtgacttaaacaacattcatttctcacagttctgagggctaagaagtccaagatcaagatgtcagcagatttagttcttggtactggcctgcagacggttgacttctccctgtgccctccagatggcgaagaagaagagctcttgttcctttttttttttacaagggcattaattccaacatgaatgtgccaccctcattatttaatctaaccctaattacctcccgaaggccccacctccagtactctcccactggggattagggcttcaagatatgaattttggggtgacacaaacatttagtccatagcaaaggttaaggatcatttattcctcttcaacgtgctattctcttagtatggatatgaaataattttatgttaggggcctacggaagtgaaagctttattagcaacagccaccgacctgatttttcacttagaaaaactatacagttggtcttagaatttaattaaattacatttataacttaatgtaatttaattcaatcttagagtctacacaaagaagaaactgctcatcttccatagtcgtttctttattatttacttgctgactcattcattccactgtacatgcattgatgacttgatcttatgaatcagaaccttcaactgaagaaactgcttactcagaatggtagataatttgggagattttttaatttttattttcttggccatctaggagaatcaattatattaaataatactctggcagccataaaattatctgtagctcccaaagtagtcagcttaaggattgtttaaaagaaatgcaatctaaatattttcttattgtgtatatatttatgtgttaatatatacacaataatttcttaatttattaatttataagaaattaataaattttattaatttctttcctgctctcaagacttggaagattttaggtcaagttatagttatccaaagactatataaatcatatatatgctttggtatatatctatcatctctttctctatatatgcacatgtaaaacttacatcccttgtcactaattaaaagagaatttaatttttttaactttctattttgaaataactataaattcacaggaagttgcaaaaatatgagaggttctatgtattcttcagccggtttccttgactgattcattttgcgtaactaggtttctttaccaaaactaggaaattgacattggtaaaatgtgtttacatagttccgtgtcctttgatcacatgggtagattcctgtaaccactactaaacagacacagaaccattacattaccaccagtacctacctcatgctacccattcatagtcaaactcactcccacccacaccatctctaacacctgacaatcacaaatctatctaccctctctataatttggccatttttagaatgttatatataaatggaatcataaagcatgtgattttttattttggcttttctccactcggtataatgacagagagatccatccaagatgttccacatatcagtagtttgtttcttttattgcagagtggtagtcaatagtatgggcatatcatagtatccttaaccagtcacctattgaaggacagttttgttgtttccactttttgactattacaaataaaagttactgtgaacatttatgtgcaggtttttgtgaagatgtaaattttcatttatctggcataaatgctttatgaaccagcaatcatgtgattgctgtaacatatgcaatgtatggcttttgtaacaagttagaaataagagctaacataaaataagtcactaaatgagaaagaatactatattatactatacttaaaatgtcaattatgtctattttttctatttgcttgactatatgttataaatacaattaaaagtttatcttaacttttaattgtcttaacttttggttgctgcttcatatgataagttcatggtgcattttctaagaaactgccacacagttttccagcatgcatgtacaattttacactcccttcagcaatgcataaaaggtctagtttctctacatccttgccagcgttcttccccctacctgttctaataggtatgtagtactctctcctcaatagtcttaatttgtgtttccctaataactagtgatgttgcacagtttttttttcgtgtgtttaatttaccatccaaatatactcttcagtgagatatctctttatgtcctttgcccattttctagttggaccatttgtatttttactgttgagtttcaagagttctttttggatactagatatcggacctttgtcatatatatggtttgcaaatattttctctcagtctgtgtgttttctcctcatcttttaatagggtctttcacagagcaaaaattttacattttgataaagtttaatttatagatttttttcttttacagatcatgcttttgctgtcatgtctaagaacttttcacaagctctataccttgatacttttcttctacattttctactaaaaatttcatagttttatattttatacttaaatctacaatctatttgagttcacttttgtataggatgtgaagttgaggttgagatgatttatttatttactttatctatggatagccaactgctatagcaacatttgttgaaaaggttatccttactctattgaattgcttttgtacttctgtcaagaaatcggttggccatacatgtatggatctacttttgggttcactattacgatgtattgatcttgtgtcagcccctctgtcaataccacagagttttgattgatgttgctatataataagatttaaaatcaagtagagtgattcttcccactttattcttctctttcatcattgtctattctagttcctttgtcatagaaattttggaataacgttttctgtagctacaaataatcttgccagaatttttattggaattgtgttaaacttctatgtcatttagaaggaaattgatatccttattatgtcgattcttttaatctatgagcacagtatgcttcttctgtttttagatattctttgattttttttcattggtgttttatagttttcagcacagaagtcctgtatatattttattaggcttatacttaatgatgtcatttttgaggtgatcataaatgagattatatttcaacttttggggtccacatgttcatttatagcatgcagaataaaattgatttttttgttactcttgtatcttgtgactgctgaactcactcatcctaggaaaattttggagattccttggaattttctatacaccatcatctcctctcaaataaggacagtcttatttcttccttttttttttttttcttttttgagacggagtctcgctctgttgcccaggctggagtgcagtggtgtgatctcagctcactgcaacctccgcctcccgggttcaagcgattcttatgcctcagccttccgagtagctgggattacaggcgcacaccaccacacccagtgagtttttatatttttagtagagacggggtttcacctagaactcctgacctcaggtgatccacccaccccggcctcccaaagtactggaattacaggcatgaaccaccgtgcccagcctatttcttccttattgatctgtatgctttttattgcacatgccatgagtggtgagagcggacatccttaccttatttcagtcttaggaaaaactgttcagtctttcaccattaagcatgatgttagctgtaggttttttttataggtatactgtattaagttgaagttctcctctatattcagttttttgagtttttaaaaaatattatgaatagatgtcgaattttgtcaaattcttttcctgcatcgatacaatttttttttctttagcctattaacatggtgattacactgattggtaaatcagttctattaaaaagaacattttaaatagttattcaattcattattagaaattagtcattcttacataataaccatttaatgtagtgatcaaataaattgttgaatgtataggaaaaaatttaaaaagatatttaaagctatggaatctgatatagtgttgatatgattattcattattaaaaattagtcattcttgcataataaacaaccatttaatctggtgatcaaataaattgttgaatatataggaaaaaaatttaaaaatatatttaaagctaaggaatctgatatagtgttgatatgagagaagaaaggaaaggaaatgagagaagagaagaggggaaaggggaggggaggggaggagcaggaaaggaaggaaggaaagaaagaaggaagaaaggaaagaaggaagggagaaagggaggaagggaggaagccccttaggaattcatggtagtacacagttaagttgatttagtttctattcagctacctgtctccctgttattccttcgtttgtttgttttctgctaccacctcccacttcctttttctttgtaaagctgggtgttccctcccttgagaattcccacaggattcagatgcaggagacaagtgaccatctgcttacttagtggtgacacatgaaatcgtgtggtgtgcaggtagaaccatcctgttaaaaaatctaggagtctccaattcagcagtctgttaaatagacaagagtagagtaaaagcaagatgaacaatgagggtgaaatagtataatcacgtaaacctatgcatggtggaaaacagacatttaaaacccataagagaaagtttcgaaaggcaccatggcaatatattgcttttatagaaagatgctatgagttggtggcagaagtgaccaactgggagggctttctcactccatcagtttttaccaaatggaagaaataagacagtgcccactgagattgatcaggaaagccagctgcactgtgcatcatttgacctgcactatataaactcttctgcaggcaaacgttgcctccctccagcactgacctgcctgacatgctcagattgtattgctgcaagaggtagggaaagaaatttggacccacagactcatttggagcaactaaagctcaaatttagtgtaatataaataaatactatagaaatggaaggcaagatgaattatcattattatccagtatttttatagcactttatattttgcaaacggcttcacgatcccatataatgaatctgtggggggctagcggatgcatatgttacaagctacaaggaatagcagttagcacatccattcattatgttttgcttacgtttttattgtctgatttgtttacatgagctatccactcttcctttctttatactgatttttggaaactttgggtaattaataaataattataatagatacatttagatgtatttggatttaaatttccagatgtgagcctgactttatgtgaatatacggctgcatagaatgcaagcatgagaactgagttaaactaagaatatttgtattcttcataaaacaaccaacatggacttcatgattgtgcttcttattctttaaagattttccgcctttcttactcttgctgcattcctccatcccccttcctacttagttaagcactggatgccctgcagcagtgtattttaaaggccttgtgtgtattggccatctgtccagtttactacaaagtagctcctcttcgaagattcctgccctattgttcctgtgaactcacctgtgtttgtcagtacctgtgctttggctttttgtatagacccaggtatgcccctctgtccttccctctgtaaatattgtctagtttattaagcacctagtgttggagaaatggtttcccatggttctgttactctggttcttattgactatctttccataaaccagatcaaagtcttaatcctcacaggagtggaattcaaaactttctagggatttatttaataccaaattgatggctgatttgtgagtaatgtgaatggtctctcaaatctaccttttgatcagagctttacaagcctgtatataggcacgttatctcctccttttccaatgagataatagatagcttagagccagcacatagtaggcccttaatcactctgtgctcaccaatgaagggagcccctactgggatccttctatgaagtggaggttgtgaaagcattaccctcaaggttaaaacctagtgtagacaatgtgacatataattgtgtgacctcaaaaatacatttgatccaattctagtagctgcagaacaggaaaaaagagaagtctaaagtgagtcatgagagaaaagttcaaaatcccaaagtttaatttgttcacagctgttttactgtcaaaggcagaaagaacttcaacagtgcatttgttggaaagaatcacattttactctgattaagaatatgctgagacttgctttttaggtcaactttataattgtaccacacattagtttttaaataactggaaaaatgttctgtacttttaaattattctttggggcggggcgggggtcagaaatttaaggcagatgttttaaattaaagttagtgttttatagtgaatatagttatatttctgaatattgaaagatctatgtaaagatggtgtaataaggaaagaaaaaatcttgttcttcgttcagtaagccacaaacttggagcctctctatccaaacttcaaaatcctaagcctttttaataaaaatattggaagaggccaggcatggtggctcacacctgtaatcccagccctttgggaggccaaggcgggtggatcacgaggtctggagattgagatcatcctggctaacaggatgaaaccctgtactaaaaatacagaaaattagccgggcatggtggcatgtgcctgtaatcccaggtacttaggaggctgaggcaggagaatcgcttgaacccaagaggcagaggttgcagtgagccgagatcgcaccactgcactccagcctgggcgacagagcgaggctctgtctcaaaaaaaaaaaaaattggaagaaaaatattgtttgtaatcagaaagatcactaatcttatgctaatttttaattatatcaaaagagtttttaaatttgatttgataaattacatttctttaaaaaagagaaaattgattacataattaaaaatttaacctgattgcagttaaaggaagacaaaatggtctaaaattatatctactaggaaaagcagttgaatatatttctcttacctttagcttattctaagatgaaggaaaataaggagaagtaattgaaatgtcagattccagagtgattgttcatttcaagtggacaaaaacctttacttgctttaaacttaagagggaactactcaagtaatagagatataggaatgtaagatgatgactgacatgtagccaaaggtggaggcagaagagaacagagagggattattattattttttaaatttcagccatctctggaacagagtattcatcttcccactcttgaacattttccagcttgggccaactgtgtgtatccagtgaggtcttgtttaagacattcagaagaaaattaagttatggaagtttccaatctcctttttttcagtaatttttccccccactagtatccttccaaaagcctctaccatgctctgggctttctgctattaatatcatctaccagaaaaataaggtgacactttttgtggagaattaacattttgatagagacatttaaaaaatgttcacatattgttaaaataacattgacacatctttttaaagaaaagaaatcaaaatcatccatattctcagtatcaaaattcaactgttgtcctttctttctggcccttattgttatagtgttatctgagcaaagaagtaattgtgagatctaattttttgtttttaatagatagggtcttactctgttgcccaggctggggagtatggtggtgcaatcatagctcactgcagtctataactcttagtctcaatcaatcctcctgcctcagcctcccaagtagctgggactcaggcacctgccaccatgcctggctattttttttttttatttcttagtttctgtagagaaggtgtcttgctatgttgcccaggctggcatcaaactcctgggttcaaacaatcctccagcctccacctcccagtgtgctgacatgagccaccatgcccagcctgaggtttatttttgaatatagcattattatgtaaatgcctcccatgttgtcccatccttcataactttcctgttttgtcttgacacactaatccatccatttaatgtctataatctattaacagtttccttgtttggagacatttaacaacttgtttaaatttttttaaaattactgatttttttttttttttgagagggagtctcactctgttgcccaggctggagtgcagtggcatgatctcggctcactgtaacctccgcctctttggttcaagtgattctcctgccacagcctcctgggtagctgggactacaagcacgtgccaccatgcccggctaatttttgtatttttagtagagacagggtttcaccatcttggccaggctggtctcaaactcctgaccttgtgatccgcctgccttagcctcccaaagtgctgggattacaggcgtgagccaccgtgcccggccccaaaaattactgattttatcagaaatagtttctactcattttttttcttctgaattatttaattgtaataaattctcttgggagaatcaaagcatgatgaatattattcatttttaccattttattttcttcagtggtatcaatttgcagaactactaggtgttcactgacataagtatctttaaatgaacaaattttcaaacaccttcacagcaagcccaaagagctgatgtactcttcaaagatttctaccaagaaaaaacaaattcaggatcttctaagtatagaagggttttacatttttttttctaattctatcttctcctatgaaagccctgattataaaattataaaagcaaagatttttttgtttgctttgttttttttaaacaatatatattgtggacctgaggaatctgacattcccttatgtccacgaagaaattatgtcatttatttgttactctgattcttctgcattaaaaataccacatgtatacgttagaagcaatttcagtattttttgtcataattgcaatgagaagataaatacctttttaaactatattttatatatttttttcaattttagaggtctcacagtttttctaaaatgtcctattagaagtgaagggatcactttggtcctcatttgtttccacagcattttttcaacctaaggttttctttcagccagaggaccataaaacacatttctcaaaatatattgtagggaacactactagtatcttgagatgaaattgtcatatggaaaagaaaaagatccaatggaactataaaatgcattcataaactcattggttctgaaaatgtggttgctggaccatcagaatccatatcccttgggaacttcttaggaatgcagactctcaggcccacccccgcctactgagtaagaacactaaggaggcagagccatcaattggtgttctttaacaaccctccaggtagttatgcttttctaagtaatttgtaatgccattatcttaaaaaagtttctgagaagttccttaggggagagaaaaaacactacaacacgacaaaaacctctaaaccttgtttgcccaaaaagttgaccaaagaatatctattttctcttctaccaatcacaaacttttttttttttttttttgagacagggtctcgctctgttacccaggctggagtgcagtggcatgatcttggctcagtgcaacctctgcctcccaggttcacaagattatcctgccttagcctccggagtagctgggattacaggagcgcaccaccatgccctgactagtttttgtatttttagtagagacagggtttccccatgttggccaggctggtccctaactcctgacctcaagtgatccaccctccttgtcctcccaaaatgctgggattacaggcgtgagccaccacgcccggcccaatcacaaactttttttttaatagagatacagtctttgtgtctaggctcaagcggcagttgctagtttcaacctgagttgttaatacatttaacgtgggttcattagtgtttgatatatttcttgtggctagaccatgggaagaactgctgtccttttggtagcgggatacgtcattgcctgatgagttgattaatctttgttattctgcaatacctgtttgtcatgcatatcttagtatatgtgaatagagtatatgtctggtatgaattgtgccattataatggttcctgataggagagattctattttcatttgctaggtatttgagataacatatttactcactagagaggagtaaaaattaagtattaatatttaatgaacggatactaagtgagaaaaaaattagagcctttggactaaatatttattatcttacaagagcaaatagctatgttataaaatgagaatatgcaaataataaaatggaaaattgaaagtaattatctttacatgtgctgtaaagttgctagttgaatttattgcctattctttttaccagttcaaaggttagtgggaaaataccgttttgacagcagacttctgacagcttaataataatgatcaagctttgtgcattttatttaaacatctatagtcaacatgctctattagtagctctccttgtatcttttgcaaaaataagattttagggaaaaatgttatgttttatctcaacaaaaaagtctagtgtatgttttatatttgcatctcttaccctgtatgtttaaattacaaagaaattccttagttcaaatgagcatgaagttgtttggcaaactgagattacatagctacaaaacccttggtagatggtatctataaatagaagtgtctaacgtggaaagtgctctgaacaatataaacgggacttttgcaaaaagaagtggagaggaggaaagcctacagcgttgatttaaaagactgtaattagaattaggttccgataattagatcccagtagactgagttctttttcctcaaacaaacaaatcataaatgagtataggatgtcatttctacaggaatgaaaatagaaatggaattttaaataaagattgtgaagcaaaatgtggcattttaattcttgcacctggaatcatttcataatgaaatgcaaattaattctaaaaatctctgacctctgttttgctgattgcagcctaaaatcactcatctggttttgagaaaaagagaaaatgcatgccaagatgaaactatttagtatataccttggaattttataatgaacttagatgactgactgtggctaaataagtttacatttccatttttaagaaagatcggaaaccaagaatggaatacttggtataaattggggatgaagccactgtgattatctgaagtcattcattggcttaaaattttgttcatccttcactagtgagttcttatgggatgtgtgcttattgtatactctttagttctaaatttgcaagagaagtaaaactggaatctactttttagttttgaaaaatgtaagtctgagcttcattaactagcacttataaaaaagaagacacactccaattgacattttcacattgatgtttaatttaaataagaaccaatatttctatggtggtgagctgattgagaggtaaaagacctttaaatctccttctgaagcttactgcccaataatattttattttctatatcattttattgaccaatgttgtcatcagtttatctaacagaaaaataaaaattgcaatgtcattaaaaatatataccaccaaaaaaatacggttgatgcagttgaagaagtaaatggcaaattcacagatattcataaaacagctattgtataagactgagactagaatgaaaattttgtatctaatgaaaataagatgtcttcttctttatttatactcacatcccctttctaaaaggaatctgaagctctttacaataagaccacctagatttttttaactatgaatagagatgaaaaatcagaacacaggcaaaaagaaggaaaaaagcataaggtagggtggtaaccaagagactcaatgtaatttattataatttttatagttagtctctgagcttcctgggggcaaaagaaaatgaaacctgtatgtccatattgtcttaagttttaactgtaaatacagtgaggtttttgttagacttaatagtgtgcatatagacacacattcagtacatgttttctgatgccttccatccacaggttacctggttcaattgtcaatgcctaagtcatctttaaaattgctcagtgcttttataatattcataagtcactgaaaatagaacaaaacaaacaaaacactggcactttttcttcattttatttcactgttgaacttgataatgttggaaacctgagcagaataagatagtttgatgattggctgggctcttcatcacggcttgcctttcagtataagatattaaaatagtggttttcaaatcttatagccctagtatcatcttagaggtttcagagacaatttccaaagtaagtgggaagccagtttacccagaacaatttactcataactgctttatccagaataagttaacttttctctactttacaatgttagattgtattttgatttgctttgaaacaaagttctgctgaaagcagtttaataatcacttaaactggtggtgagtaaagaccaccaacagtgctatagtaaaaggaactgatagatgaccctcgggggtgaggtttgtgaaacctctaacaagggaatcctaactatggatggatagtttttataatgttagcaaccctctaaaattgtaagaaaatgctacatattttacaggcaattaatctagggggatagccaagagttttcttcggttcttgtattatcattaaattttagaaatggataaatattttttaaaaagcacctagaatggatttattgaatagttaataaaagaaataaaacattataggaaacattgaaatcccttttttaaaaccctccagacatatttctgttgttctcttctcaaacacaactactctttttaatttggtatgtataattcctgttttttacgctttcactacatatgtagatcctgccattaaaatacatgttgtgttaattgagtgtttatgaaaattttcataaatattttaccacaaatgtcattaaccatcttgtttcatcacattttattttattttttgtgtgaacacgtatagtttctagttcatttaattgcctgatgcagttctatattatgaatatgtcacatttaatcaattcatttcatctctatggaaaaatactaaagtactttccactcactcactaggtcaagtagcataacagggaacatctttgcacacatttttaagagttggactagactggaatgtaactaaaagtgtacttgaggctcacagagtatgcacatctccaaattgtgtttgtaaaatccaagttatcatccagaatagctgtacctgtttacattctcctcagcattgtatgaaggttcagggtttttggcatccaacagtggtactgtatattcagactttaatttttacagttgaatgggtataaaagagcatctcactgctgctttcaagtgcatttcccttatttctagtaagatatcttctcacttaatgtccattgggtttctttctgtgaattgcctttgtgttcattgctcatttttttccctagtaggttaacatctttttctagatgccatgtaggagttccttacatatttggtataataattatgtgttgccaaaatacatttattcccagtctggagctgctcttttaactttgtccatggagacagattttaaaattatgttttaaattttattgtggaaaaaatgtgcagatcttcttctttatggtttctgccattcatgtcttcacaaatccctcccaggctggatgcgataatgcatgtctgtaatcccagtcctttgggaggtgaaggtgggagaattacttgaggccaggagtcagagaacagcctgggcaacaaagcatgaccccatctctacaaaaaattaaaaaattagccatatgtggtgatgcatgcctatagtcccaattgcttgggaggttggggcagaaggattgcttgagacccagagattgaggctgcagtgagctgtgatcatgtgatcacaccactgcactccagcctgggccacaggagaaaaccctaaaaaaaaatccttttctataacaattttataaaattatcctgtcaatcctataccttcttttaaaaaggttaaaatgtttctatacctacttaggctatcaacctcacctggccagaattctgtgataggccatgtttctataaatgtacaacgctatttctgtgacctctttttgttgcattgatttaactctactccagatttaaattttcagtgactgtagttttataaccttgatgtctggaagggcaaaaccccatatatcttatttattatcttcaaaactgatttaaatattcttgagattttctcttctaggtgaattatagaattattttccttttttgttttttcttttcctttttagagacagggtgctgttctctcacccaggctgaaaggcagtggcaccatcatagctcactgcatcctggaactcctgggctccagcaatctgccagcctcagcttcccaagtagcttggactacaggcatgtcactgcacttagttagtatttttatttttagtagcaatggggtctcactttgttgcccaggatggtctcagactcctggcttcaagtgatcctcctaccttggcctctcaaagtgctgagattacagacatgagccactgcacccagctttttttgggcacttttcaagaagaaactttctggatttttattgaaatgtcattgaatttatagattaattttatgataattgttactttttgaacttgagtcctccaatccacaaacattgtatatttatgtgtattttgacattttttgtaaatatttgcagtacttttccttgtaccttttgacattttcatcttttacatgcatgtgttgtaacttcattttgccacgtctgaattttttcatttgtcttattttgatgttcattcttttgttgatttgtttattgtttgtttgttttccctctaatatgagaattcatgtcttttgtcaactctggaaaatgctcagtcattgttgcctttatctcattctctattctcattatttttgaaactcatggaagactcttgatatgcataaaatcttgcaaaagcttcagagggaaatatatgtataatttctatatatatatgcacacattatatatagatatacgcacatacacacatataagtgattttatcatatatataatcacatatgattataatacaatcccttatatataatcacatatatacacatatatgtatatatacatatgtaattacacttacatacatatataatcacttatatgattacgtatatcactgatatgtatatataatcacttatatgtgtgtatgtgtatatatagtcttatggtcgccaaattctcttttctatttttcaactacaccaagcccactttcgaccacaataatgctatttatatctttacatgtttaccttccacataagattcatttgaagaagagaacacagctttccttggtgccagctttccctgagtctatgtatttttttgttatacagttgtgttttaagattgtacagacagttgatataactgatctttggaaactctattctgaaagaatagagtgccactattcctgagcaagaaagagatgttttcaatttcatttcctgaaccttcccactctcccgttacacttaacttaaacaaatgtacgtacatcattgcatttataactatcagagatacaagtcagagaactggccaggatgttcattaatcatgtttgctggtagtaataaagggaaaatccttaaaagctatgttgtttgccttgtgggtgttagtcacataaaattcatggctttgccctaaactagtgcgcagtaaagaccagacaattgcttatcatgaggatggattgctttggcattagtgcttcctgacttaaaagaggggcttatttgttcagaaaatgggccggcattggatgagctttcattatttcctgcctctacttgtgtactcttgcattttgcaaaatattgccagtcttctgttattcaagtaaatgtttcaactgtctatataaatcatttctcttgatgcaaccaaattatttaactcagaaagtccatccatcaggtgcttcacaatttatcattattttaaagtaattggtctactcagtagcataacacttactgacataataaagtcatgtggattatagataaactcgtgagatacctggaacttggaactatcattcctatatagggccaaataatccactattgatttggaacaacaaggtgaagaaaattaagcctccccaattccagctagtattttaattgaaagagctccaagaaagactcaggtgctgtaattgtgcggtaatttggtatggcagcttctaattatgaagcacgaataagaacaaccttgggaaaaatctcggtatgccaagattcacccattgcagaagcagaatctgagccaaatggtaatttgtgaggttattaaaatgactattaaaggcttggatcagataccgctcaacttctgaactttgagttaactagaagttgatcagagttagctttctggagcttttcatttgtttctgtattttgttaaaagaaaaaaaatctgacttgcatgcttattgcatgttaagtactgtgctgggcattttatacattttagctcatttaattaaattatcataatgctatgatagttttagcatctaaactagcctaaaaagggctagttttaggccctttttacaaataataaaattgtgtttcagggaggtgagcaaatttctcaaggttatccagctaatcactattcaaaaccaggtctgtcttttcccaacgcctgtttacttccctctacaacaacagtaatgatgaatgaatgcatcgacatatgttcatctcaaggctatctcagtgctccttaagcattatctagtttgactgggaacttttttgaggccatgtggtccatgtttaccaaatgattcaggcatatctagccatccttgagaacttgtcagagcaggttaagaggttaagagacaggcaatattgttaatacttgttattaatacttgcttcagtattctccactttgtatttgtggcaattttggattggtaggtaatgaatagaagatagagttacggaatattagataattttataactctttggatgcttaagagcctagaaaagtatataaatatcagcagtgcaaggagaaggaagcaggttggatacagagagaacttggaccctttgattgctcagcaggtggttggatatcctgagatggggaagaaggacagacctcaatatctctgcattgactaactgggtcaatacagagctgcctaaagttgtatttaccgctggaaaataaaagtgaagaaatagtaatcaaaacagatttttatatgccttattgctaaaagtgagtattatagataatgccactaatttcagtaaaggcagtcttattccatattattaccttactcctaccactgggactgtgagaaaacactaaaccactagcattgtctaatttgctactacaaaaattacttctaacagaaagtgagagattaggggattataaaatgttaatgctggataagacttttgaaaccactcctgttttacggatgaagaaactaaactagagaaatgaattagctagttcaaagtcagacaactagttacccataagactaagacaaaaattcaaatgatctgacttccaactcagtgatatacccacaatatcatgccaacttctagttttattttaatgttctattcttattttttatttatttattttaagacagagtctcactctgtcgcccaggctggagtgcagtggcgcaatcttggctcactgcaagctccgcctcctgggttcacatcattctcctgcctcagcctcctgagtagctgggactacaggcacctgccaccatgcctggctaattttttgtatttttagtagagatggggtttcaccgtgttagccaggatggtctcgatctcctgacctcgtgatccgcccgcttcggcctcccaaagtgcagggattacaggcataagccaccacgtcaggcctctattcttatttttaatgttaatttctttaagtgtattacatttgaacaatgtaaaactcatttctattagaaaacagttagatttctagagtctcttcctactcactggtctccacaggggaaaaaaaggaagactgtgataaaaagaaaaagagaaaagagaaggaataaaaaggacaagaaaaaagattattttgcttcatttttagctatttatcctcagataaaattgagaactgaaatctgaaaaccgttaaactcatgacttacttttattatggaggaattagtttttccttttattatggaggaattagtatttctcatttatctttcagctctcaagtactccctgtgtgaattcgaacatttattccacttaaaaaattcacaagaaatgcccaaagtctaacatgtttccagattgggaatattttcactaatacagtactttgtcctcctgggtaagaaagaagctctctgattactggtctgaaacttagagaataagacaatgcttttcatgtaattgattcatatacatgggaacgaatgcctttgcaaagcagttatttctatgcctgacctacagagagtctgtagtgagccacgcatgtggtatcattagtcactgatgatgacaacgagaacaggaagattggagtggcaggataatcattctcagcaaactaacacaggaacagaaaaccaaacactgcacgttctcacttataagtgggagttgaacaatgagaacacatggacacagggagggaaacatcacacactggggcctgtcggtgggtgggggcctgagggaggtatagcattaggagaaacatctaattagatgatgggttaatgggtgcagcaaaccaccatggcacgtgtatacctatgtaacaaacctgcacgttctgcatatgtatcccagaacttaagctataagaaaaaaataaaagaagagagagagagagagagaaaggaacccaaagtcctagaaaaaagcatggggccagggggattcgttttcaaccttggtatgagaaaggctttctaactataactcaaaatccagaagcaataaaattgaaaaaaaaaaaaaaaaaggaaagaaagaaggaaagatgggtggtagagagacccagtagagggcagcatcagtaatccaggcatgaggagatgatactgtgctggaatggtgggggaagagaaaggtaggggcacatgctggagaaactttaaaggaaaaattgagatgtatgagtgattgaatgtattggagttaagatactgacgattataataatgtatcttgcatttatatgttatgttatgcatttatttgtgctccaataaagtctatcatatcattgatcaaaattactatatagtcttcctttgttttgagaggataatttatttcaggaagaagaaataaactgcacaaggaaagttcttctaagtcaatagcttatttaccaccaagattaatgacacacaatcactttaacagttaaaaagtatatgtgatttttatatatgtgaaactttagtgcaaatcaaactcaaacagaatagtaaaaacataagaattttttttcaaccttaactgatgcataagattatctggactataaactggaagactaccagtactcagaggagagaattcagtgcaacgcatgccagatttcataaaactgcaaagatgactgcatggtgactctcgtttcatggtgcttagctgccactgaggcatgtgaattctaaattggtcttcataaatgtgaaggaatgcctggaagtcaaaggaaagcattaaaggaaaccccttatacatgtttaattctcataatctgattggttatatcaagaggtatgactatatataaatgtattacaaatagttattgaaacacattgttacaatagttattattggttatatcaagaggtatgactatatatgaatgtgttacaaataagctatagttgctataatgtttataaattacacaacacctaaagtttaggaagtggatagcatcttctcatgagatggatagcatctttatatatctctgacttttccactgggcttcaaatgcatattaaaggacattctataaaattaccagtattccatcatttttggtctacaaaaatgtcagtttcacatagtttgacctaatatttgccactctcaacttgtcatttccacttggcatagtcttggcattacgtaggcatatgaaaatccagggtttgttttttttttccaccgaaacctgttccaaccacaggtggtccacagctgtccacatttcagcaaatgatgtgatacgatcattcactggatggctcacgtttcaaacctgggcataactctcacttcttttctccccaaactcacattcaattcatttgcaattgcttttctcttcacctggaaaatgtatgtctaatttgtctactcctctctgtctccaccattagcatcctagtttgtcattattttttattgaatttatgtaagagagtcctagctagtcacttagctttccactcttgccttcctctaactcaatctctaaacaagcacatgaagaatatttaagaatgtacattagattatgtcactcccatgctttaaacactccaagggcatcccatgacacatagaataaagtccaaactacatataatagttacaaggctctgcgtattgtgaacctaactttctgatttcttctcctactccaggattcaccatactcaaagtaaattggaaaacagatcttgggtctcttgggtcctcttgggtcctgttgttcccttttcctgaaagctcctctttatctttacataattggctccttcctgtaaatcaggtctcagcttgaatgacatatctttagagagatcttctctgacaacatattctaaatagccacccccatctgtcattctttatcataccatcatttaaaaaaaccctcagcacagcacttatcacaatctgagtgatagatgtcttattcatctatttttgtagcaggatgttagaatgaaagttttagttgggaaatattattttacaaagtgaacaagaggaaagaagctttcaaagtaggactagggagtcatgtggttgactgtaaaaattcctcatccacaaagaggaaataaaagaatcagaaaaatgaagattaggaaataacttagggaaagttttttttttttcaggtaaccattggagttccattatttaacaaattgaatgatataaacttataattaatgttatattaaaacaaagataataaatatgcaaaacgaatcacttcttaattatgttgttatgttttgttattatctatgctcttcaggtaacctaagtcaactggtaggaatactacatacacagtgatgtattacttgctgcatatcttcccaactctgtttttgataacattatattgtgcacgaaattagccatgatggaactgtttacaccaagaaattagcaaacaatatagattaaggttttattgtttgttaataatttcaacttcaaaaattgagaaaatattaataatgcagactaaacttagtgttgtgtcagtagctataacattgtgaatagcacaaaaatcaaagaaatattctagtattctaaagctagctaatataataaaaactcagtcacatcactgagaacaagtaaattcttgatacactttttcactctttcactttcatattactcattactgtaaatgaaaatacagaccaatacccacgttggaattatacatgtttatcagttccaactatagattgactacaggtacaaaaggttgacaagcataaatgtacttctataagaattaattaactatgtggaatttgcagtaaagagtattatatattttattattgactatgagttgtatgctatacctctttttattagcaaaatttataataaacttcatacatgtgtgtatccattatttttagagagctctttgttaaacatttaccagcacagcgctgtgatagacccactatctagccaagaggaggcaggttacttcttttttcaccttaaatcaagaaagggacactttactaaggccaccgagagagcacagactatatcccccacaactgggggaggggatactgtgaattggtgtcttacttcactttaaaaatctaggccaggcacagtggctcatgcttgtaatcccagcactttgggaggccgaggtgggtggatcacttgagtcccatctctacaaaaaaaaatacaaaaattagctgagtgtgatggcaagcgtctgtaataccatctacttgggaggctgaggtgggaggattgactgagccagggatgttgaggctgcagtgagccatgattgcgccactgaactccagcctgggtgacagaaggagaccctgtctcaaaaagactaaaaacaaaaaatctaaaaggtgacagatagccttgtctggctgttctaagaagaaaggctttagtgacttaccagcgtgggaagtggtgttggggcaaagtttgtgttagtgtttcctgtggaccagagatgagcctcacatgagacagattaggcacagggtgaatttagatcctctaaaaggaggctgcccagatgagtaaaatggatgtgtataaaggagctacaaatgactcctggatttctagagaagaaaagaaggtggcatcagtattactaaagggaattccaggtgacaaatccctagctgggaagggggaatctctgaagaagctttaatatgctaaaaagagaagggggcagctttgaaccgctgaaagaggagagtgtactgccagcttgtgacagtactactagtcacaataggactttgctgctccatttcctcgtgtctgttagcggattcacaagttgacgagcaggaggagaagtataaattgagaaaaaaagattaaaaacagcacttctcgccactccctcattccctagcagctgctttccacctacaacaggcctggcaatgaaaggctcctcaacttttcataacgttcactttttgaccattaaataaaactggatatcccaggagcagaggaagacccagctcccatccaataaactgaaggagatactaagagacaaaaatatgattgccttatgattaaactctacaaatcatgcttctttaatgaaagaattatatttattttccccttaaaattgaaaaatttaagaaagcagggcttcagtacataggagacacccagtaaatattaattgtatgaataaacgtagacaggaatgaatgattgctcattggttcttcctttggcacttgatgaagcagactcagagaagctgtatatataaattgcttttaatataaatattcttttggtaggaaaaggagaaagaatgagaaaattcaattctgaatgattaggagaaagacagaaatgggtggatctgaagaaagaaccactttcatgtgggaaaccaattcatatgatttctcatcagtggcatggaggaataattgttagacacttacacatccctgaaatgtgtcgtcagtaattaggacaggccctagattctagaggagggagacagaaatttggccaagaaatgaaggggttgaaaagttttctgagactgagggaaaagaagaaaggagaaacataaattcaggtatatactgcaaatatgtaagagcaaagaagacttcaggtgaactctagatttttattttcatgtgctcctctccttcaaattcagaagaaaaggacaaagctaaaactatatgaaatccttcgtctaaaatgacgaatctgaaaattccagaaggtaggagcttagtttcaatgagatgaagaaaaagcttctcattcatgaaatacattttaataagttgaaatttgaacaccaggtgtatgaaaagaactagaatttaaccatatgtgttcagaaatatttagcccacatattttccagaataatccccaaacatgtttaaggatataattggtaagtaagaaatttgaaatccctatcagagtttgccagagttgtctaagatgcattgagtactttcagtaaaccagatgctgcattttcaatccttacagcactgagaagatactgttctagttgaagttgcatgactcaagtgggtcaaagcttgcccaagttccctgagttaagaagtagaatttcaaacacaggttgaactaaccttagagtagggttttcataacaacattcgcttcccagtaggagttttaattttaacatgatgttccttttggatttaatgttattaagggacatagtggatgaggctgactataatttgctggctttcatataagcatcaaacaattgcatttccttctccctatcatttttagtcctttatgtgcagccttgcagcattgatctccaggaaagcttgtgttttctggtgcacttcccagaaacaaaatatgatatgtgttcccttttgaaaacaattgataagtttcatgttgacagaaacatttcattttccaagtcatttatctatttgtcataagaggaattataatagtatattggcttccataatccaaatccattccctttagtgtatttttttaattaatacttctctacttaaattctgatctaaaaaagtggccattaattaactcagggagcaattcagctatttttttttctaggaaatgggaaatctggtaaatggtttgtacttctactttgtcaaaaacatgtatttttccaaactgtatgagaactttaataacactccataaatttcatgcttttagtcacacttggaatggaggctttgggaactctataaccttcttaatgacatgttggcttggcctcagcactgtagcttcaacttggttcttaatggacattaacccatagtgcataggcttcaggtaacacagttggtgatttgtattttttttctggaaaggtccaagacagatccaatattatttccttttaagaatttatccctttttgagacagagtctcactctgtcacccaagcttgagtgcagtggtgcaatcttggctcactgcaacctcccccactccccaggttcaagggatcctcccacctcagcctcctgagtagttgggaccacaggtatgcaccaccatccctggctaattagttttgtatttttagtagagtcggggtctcaccatgttgcccaggctgaattaaaaatatttctcatgaactacatgaaacctcgtaagtgtgaaggcttcttgaggacaaaggttgtatcgtgcaaacctttacatatcctaaggcactaattctttgcccattcttgtaaccaataaacatttattcagctcctactatatgccgggtgttatattaacggctgggtcagggcacatacttatgaaaatagtgtatttatatatactatctttcaaataataaccagtacatttttacaattaaaatataaaataaaattattttggcttgtatgtgtgtctttcctagaaaagatttgctaacagtaaaataaactttatagaactatcattcactcttagttgcatcttggcaaatagtcaagggcccttccaaaactttgcctgtatacactttggattttaattagacacaataagacccccctccttaatctggctctgcttcttgacaagtcatcatgaaggtgtgataatatcacacaggaaattatcaaactgctaaaccaagtacagaggagacaaataaaatgttgatgcaacagctgcagagactgtcctgaaggttctgtaatcaatggtgtcttgagagtcgtatctgaggtagagtctttccaaatgcacacagtgggtggggcagtggtatctgaagtggagaaggagggcagagaacatggtatctacacatggcagattcaagttcatgcaagcaccctgaagacagagaatttgtcttgaataattttaaatttagcaagatggaactttaacctcataaagaatggaactcggtgagttttggaacaaaatgactgtttttggactcaaatcatagaaagcattctcctgcaaatgtaatatatccatttgtctttagcaggaaataaatgaatttatttcaagatggtgtcccagagaaggcctgaggcacaatcatatttaaactgtatgaatactgagtgacatgattgcatccagtgtggtctggattatttgagcaaaccatggggacatacttacctgtttatttccctacatctgtttatttccctacgtgttcttgacgttagtgtcgaaggattaccctgagacctgtctcagtgtcctcttgagaatggatatacacattgacataaattattaacttctccctagataggtccattaattttctgtgaattgttatggctttattagtttcccatcagttattcttggtctctttccattaaagagaaatccactcttacttaaatttgtgtcttgcactaaagttaaattcagccaacttcgttctgaatctatttaatcctaaaattatttatttaagtaaactttcatgtatcctcaggagcctcttttcctgaaaagaccaaagagaaactttccttaattaggcataaaataacagttctaagacttgttttataaatgacgatctgttctataaggttactgggtcacgagagctaaaatctttggtggtttttgaaaactgatacttgagggtctgaaaagctgctcggtttcagtctcacattgacaacgattaagatgttgagattccagaagtgaagaccttacacaaggagatgacagctgtcagtgtataatcagaaaagcagccatgaagtgataattcctctgtttttcttctgtgatgtcctagtagaggtgattttaagtaaaatagattacatgtcatggctattagcaaaggcaatagacttcaccacctttgccctgagctatgttatatctgcaagatcttcaacaatagttcaacttacaccaggaatatattagctcgttttcgtctatattcatacgttctactccatgtggctttctgacttttaaagttgggagggagtttaaaaataattttatataaccccttcactttaaagataaagaaagtgagacccagagaaagtaagttatcttccaaggtcaaagcacttctagcagtaaaactttaagagaccatttgggaaatttcattatgatttcaatggaagtcactaaaagtactattgagatagtcaggaccctggagtcagtgagcgatgctgaattgctgggtccagggctgatgaaaatgccactgaaactgtaatagcttagccaataattacattataatatcagaccccttgcaatttttgtgtcttgatcattgaaattgtaagaatgttagtaacagaatatgttccttccaggggtgggcctaacaccctattcatttttttccccttgtacaataaaagtggtgccacaggcatattgaccaaatcattagaaaatcaattactattgagttagagctgaacaaaatagtttgaaaagtatttaatttatcccttgtaatatctgttcttttaaagttcctgtaatctgtgatccctggctgactcctctgtgatccctgacagaaaacctcattttcaaatccttttttccccctttccccctgctatccttccaaatgagaaaatcattaaaggaaaagaaaaaagtattcagcacagtgagataagagcaaaccagctcaactattatgagagaaacgcctgtttccctaactaatcaaaattcacagtaagtgtgaggaaaacaaagccaaactggcagaaataatacagttagacttaggaaagacctagaatgcaggcatatctcataaaaaggttatttagaaataaatctgatggctgtgaggtgagaagttaatgttagcatagagcagaacctaaagtcacttgattttctgctatttctgaaaaggtcacctaggtttaatcatatattctactttcttccccttgccttccatttctcccttccttccctctctgcttctattcctctccctttcttccctctcttcctacctctctgcagtctgcacttttcccttccattctccatcctttctccttttattcctctcttctttcttccttctcttcctctttcactgtctctctttctccccttctccattccttttccccccttccccctctttatttctccctctcctttctctctcaattacatctttcttctcttttttctccccacttccttccataaaggaagctcttttgttccaccctctacaccaggtcctggagttacaaaaacacagcagccagacaccccacactcagaccttacaggcaggggcaactgacaagttttcagtactaaaatcatgtgttaagtactaaaactcagggatttttttttttttttttttgagacaggtctcactctgtcatccaagctggagtgagtggggtgatcatagctcaccgcagccttgaactccagcctcaaactcctgagatcctctagcctcagcatcctgagtaactgggactacaggtgcatgccaccatgtccagctaacttgtatttatttattttttttgtagagacagggtctccctatgtttcctaggttggtcttgaactcctgggctcaagccgtcttcctgtcatggcctcccaaagcacagggatgttttaaactgttagtggaggggaggtttcgctaaactcccccaacctagggtgatctgaaaggacttcttggaagaaataagacctcagttgtatcttaaggaagagtaagagtaagccaatgaagatgggagttgggatggaaaaggggaaggggaggctgaaaagggagagtggaggttcctgccatggtaaacagtgtgtgcaaatggggcatggaagaagggagggagggagagagggaaagaaagtaatacagagagaaaaacaccaagattcaaagacaccaagatgttttggtctggaacgtggatttcaggtccttatgctgatctgtctcccttaaatacaatgagtgccttagaaaggaaaccatattatttattactcccttaatagaaagtgcttctttacagtagtggatatgtttgacatattacatacaagatgcccggccaaatttgaatttcagataaacatcacattatttttaagtatgtctcatgtaatatttcatgtatatttgcactgaaaacatgatctattatttatctgaaattccaagataattgggtgtcctgtacagttatttgctagatcagcaaccctaattaccaagcaccagatagttaataaaagtttagtgaatgaatcactaagtcagtctaagatgtatataagaaagtgtcaggagattcaggtagacagctagtcaagttaaagtcaaatgtttaggagtcattgctggttattaaaactataggccagcatcacccaagaatgttgtgtaaagtgagagagaattaaggatgagtccctgaggaacaaaaagattcaaagagaaagcagaggaaaactggtatccaaggaagaaatccattcattaggaatagaccttggagaaagtgaggacatgaagaccaagaggagtgcacttcagaaaggaggaagtggccaacagggtcaaagaatttaggagtcaggagggtgaaaaacgtccattgatcttagccacgaaagtatcactggtggtttcatcaagtaggggaggtgtggatactagccagatttgggtgagttaaaaagttaaggatgggccaagtggagggagtagagacatggtacctgcaacctgttgcctctttcaagaacctagggttgccagatttagcaaataagagggtacccagttaaatttgaatttcagataaacagtgaataaaagtatagctgttactgaagaagagagagaggggcaatgcccatgggggcatcatttaaagatgagaagatccaggatgatcctatgtgtgaagaaggagaaggaagagtgaagaaggaagaaagaggaagaaaggaagcagaagaaagagtgaagttgaaggtctagaagaaattacagaaagaaaaatttaactctagggtcacagtctctcctctgaaaccgttgaagcctgatgccagaattttccctggaaaagtaatatggtttatattttctattagcactcccctgggggttctgtagaaaccccataatcaaatatgttaatatttttaatagaaaagtgtgaatatttttactaattaagataaaggctgtaaaatagcctcgtttcagtttagattttgctttgctgccaatgaattatattaaaagacaaacaattttggttttcagagctttttaaattttgtaattgatgataaggtattaagaatgtgctcagttctcttcttggccccaaggcaagatgaagcaataccgttaattatctcttaaatatatatcagtcaataatataactgttccttcccagtctactgtagggagttcagtgttgccttaaatgttcctggtactaatttgttttgcaaaatcagggtaaataatggaaaaacaatatttaaaacacaaagtaaagagaccagggaaccttgaggttctgtgtgggaaatggaagagagactgatgggaagataaaataatgattctcatggtaaaggggaaaagagagagagacaagcactggttgggttcaagagaagtttctgaggatcaggtcaaaagtgttccagccccagcccacaaactccttcagggtcttaagtcagatatacaagtcgtctctggaagagaatgatgaaggagctcaccgacagtccctgtcactcgtcctaggagggatgactattacggcagagtcccctcctcctgatccttctgccattaaggtcccaggtcaatgtcagcttatcaatgggatgttctccaaaccccctatgaaatacagtgccctctctccacccatccaagttcatcccccattacattcaccagtttcatttttttttcttgggcagttattaccatctaaataatgttgcatatatattgtttccttgattcatttttctctcaccactagaatctaaatctcttgagaactgacactttgtagccttcagaatctagaacagtgcttggcacatagtaggtgctcagtaaccatttaattaaacatagatgcagaatggaagtagaccacaccaacgctccatgaattaaatggatatctattacctgctcttgattcctatccattacagaaagctaaagaacttagcttccattttggggggaaaataaaagttccaacttttactaagcattaaaaaaaatctgtaggaatacaactcatttatgaatttcaaaatgtttgcattttaaatgcaaccagaaaagaactatttgaataagcaggcatttagaaatgtaactgcttctaatttgattggtcacataaattcagtttttttgcaaagcagatttatttaagtcagagaacttacaaaattgaagctcagcagtgagagttctccatcacacttcctaatccatgatatttcattgatgcattgttcatttggaagatggagatgacaccagtgtctgtgtgtggatccaaatatcccagggggttcaacagcacctcacttcatcaaaacagagaaacaacgagagagctggatgaggcacctaagatgacagctagaggtaactagatgagttgatggcaggtaaacgctatgataacaagtagaaaggagccaataaatactgggctggagcagctcaaagactcctgcctgcttctgaggtttggatgatccttctaacctttaaaagtgggactgaggaatctccctagacagtttggcacaaacatctgctcgatcagtgcaattgcttttgtgtgctgccttttaaaaagcaaaatatttaatggcagtaaaaaatgtgtaagaaatcatcctggagatacaaagttgtattctgggatttgatgattttgttatgtcacagccaagttagtatttttagttagccttgttaagcccttgaacaggtgcttggagctgtgtagaacatagaccaggtctccagtggtgaatctgactttgccaaaggcgagcaggtctcccggccacagccgtaagtctcaaggagtccatgtcttatggaagtttataaggactcatttctgccagccatggggttggatggcagttacaagaagggcatttattgggatttctgggaagtcaccaagatcttccattaacccccaaatgtccatttcttctttattttctctgattcctttgcttctttttcacctgtacaagttcttcttggaaactatgtagaattgtctgggtctcgttcattaaaagtgaaaaggccttcatcacttccagagttttgatttaggccaccgttgaagggcttcacttttatttgtaaaacttacctatcagtaagaaaaaagaattgagttttcatattaatttcttatgacaaacaaagcaaaacaaagcctagaggttatcaaactattatttaatgtaagtcagctcccacacattgcttttacatcattacctcagtacgctaggtcaagggtgctttgttgttgttgtttgtttgtttgcttgttcatttttttaagtggggaaaactatggaaatgggaagcaaagagatactcctaatggtttatttaattaattttactatttggtaaattcagataatgcacacagggccaactataagcttgaaagctggtattaaaggtaccattgcaagaagattctgacagttagaggaactacaggaaagtgtcttttcataatatgaaaaaagagatccttattcttgccagtatggtttgggttcactaatacctaattatccaccatcattgacttttattatgattggttttctaataggtgatattaatattcagtgtttgaatatgttccctattagcatgaggaaaagccaataatgtgacactaatatcatatttaatgtgatttattattttaatttttatgatggcttttgatcattccatatttttatattcacgtttcaaggttgttagacttttttttcccaattacttctgtttttgcataatcagtgtcattttacctaatagcatctctcttagatgagtaataatgctccatcatgcctctttaccaacaggaagattcagagatattaaagtgatttacctaattttttggaagttcctaacttctgttttgaggattggtgctttccttcttccttccctctatttctcccttctttttgttctctctctttcccttgctctcttccactcttcctcctgtactgttattttcctccctgtttttcttctttcctctctccctccctctctgtcttccttttctttcctccctttttattttttccttctagagtaaatagtattagaaaaattagtttctgcttttttaaaagaggaaattgtacagtgtaaagtgatcatttatattcaaggaaaatgctacctaggacatgccttatctcaccccagttctcggtgctgctaagagggtttgagaagcatgggataagggtggcggcaatgtggctgcaacagtgccaggtgagcaacccatgtccgcacgcctccactctcatttcttgtctggactcaagaccccagtctaagagtggcctataattctcctttctgattctctggcaacaggtgaatcccatgatccctgatgttgacatcaagcaaaagaagccatggtctctagccagtagattaacaacacagcatcttgggtgctacagcactaagataagcttaatcatcttccattatttcatgaggttgattggaatgagtgtgtgattggaagggaacagatggggacaaagagtaaactctacatctctaaaatctaactcaacatctttttctcaaacctgaccctttctccagatgtttttgtttctgcttcatttcagcattcttccttccagtcacgtgtgctcaaagtgccaaagttatctttgactcttctgtctttccatcccagtttcataaatttttcctttattctgtttgtgcaatccatctcttccactcaattttgcacctctatttgcttctgccctcccttcaccccacaccaactgttgaggcttttttctttctttggccctatctctggatttttcttattcaatttcatttcaatgtccgctgttagtttaatgtactatcttggccaaataagctttcactccaaatccttcagtgtttttctattagatacataataaagtaaaaatttcttagctcagagtataaggtctttgataatcattccttactcacaagtcctttggaaccatccaccttctaacaaggtaagcctgccttcttgattgctctctctctctgagcattggctattacgattatctctgcaagtcatattttcacacctgccctcttgtgtatgcatgtcccccccatgcacatatgcatgtacccttgcctctgaccttcccttcatattactctctgaattacaagttcctgataaatatcttaatagtgatgctgatgaagagaaagaatagaacagatttaaaggggaaacttctgggatggctttctggccagaggcttatcgttggaagtgtcatacttacccttttgccattcacgggagatttactaaataaatgcaagatggacaatgtcaaatcatatcaactctcctaacagtgcagcaaacgtaatataggattgtgatatagcattggtaccaaaaatgtgaaattatttatgaaaaaacattttctgtctttgagctaggagcatctattagaacaagaaaggaaaacaaatgcctacaattttgggtcttttcatatcaacttggaggcaaggacagtggcttagtcctcttgtaagatagcatctttcttccattgtttgttgcccaagctctggtagacctctcagctttttatggcctgccagcctctaccttttccccaggagttgtgatacttacagtattaaccaacaaaagggcacaatgttttacatcttaaattattcctcttgcacagtctgattaaagcttgacaatatgaaaagcagatgacagggccaaataaaccagccatcacttgaggtcacccaccattttccagtgtaagtggttctgaaggagtatcttttcttactttgaggttgctttagagacatatagctcaggtcttaatagtcagtccaaactctcattcacagagcattacacaagtgtattccaccctggtactttgttgggtttctgttgaatcccaaaacactgcttaaactcacctcaattacagggtcagcagtgcatctgcaggcaacatggcttctttgttatccctggtttgttttccctggctcagtgacagaaacttgacagtccagtgtaggttaaactgaatgagcattttgtagcataggtgctagtcccaagtctctccaaggacatagggctcaagtagagtagactttattaatgtccatcaaaggtgaacctagtcttcaaaatgctgcctgtccctccaggtgcatcaaagctactaattaccattcttccttccttccctactttggatgggcaatgaagaaaggagagagggtaaatgaaagatattctctttactctgtaatttgatatcacagtaaaatcctggaaaagatgttgttaatattcaccaatgaccattatccctgccacagtctacccactaccacatccaccaatctcagagtgctttgaacataggtttcaaacataagcagaacactggaagtatgtgccaaagaaaatgcatttgaatgtggtccattatttaggaacagtgagtttccaaccttatttgtctttctgttgtctatttttgtcatttcttttgtcctaaaacaaaaattatttttcttttttgaaacatttttaaaaattctataattatattaattcattcatttacttatttatcatttaattaacacaagggttggcaggctttatctgtaaagggccagatagaaaaaaattaaatattttaggctttgaagaccgtgcagtctctgtcacaactacttatatctactgctgagcatgaaagcagccacagatagtacataaatgaatgagcctggctgtgttccaataaaactttatttacaaaaagcaggaagtgagctgttgtttcccgacccccaaattaacatatttgactagctcctatgctttcattaccatgctagcttcaggggacacagatgaatagaactttgttcctgccttaagatgccaataggttaatgtttctggaaacaaggcaggccttcgacaaagtcacttttggtgtccttctatctctctgctgctccttttcctgccactttctcagacctagtactgtccactctgatatgccatccagatgttatgtaatgccatggtattacataaatgctctcccattcctcttctattgcaacttgctgactctcagcacattgtcttcaactaactggaagacataataaaataacgtacatcaaggagggaatcactggcagtagcttaatttgttcatccttcaggagttcttacatattaaaagaggatattttaaattcacagacatctacctctacttgtaaaattcccggcagaggactagaggaaatctttctgagcagggaagtccatgacaccatctaaatctcacagaagtgaacataaatttcctcctgtgactaatgaagataactcacatgtattgagtcactagcatagcagtcattgccctaaatcttccaggtaagatttactttgagctccctagtagctctatgagtcaggtgccattattagtatccccattttacagatgagaaaaccatagctaagaggggctacataacttgataaaagtcacacaactctcatgtgagatcgtatttgaacctaagtagtgagcagccttaatactgtaattatgaagaagcaagtcttctctaaatcagacatagttgagctctattatagaatcttagaagaggaaggacaattaaatattgcttagtataatcttattttaagaacaaggacaccagggctcagagagcgttttggatttgacaaagtagcttcagactgctggaagtaaaatgctgttcttaatgagttttttattttattttatttgtttttgtttgtttgttttggtcttagtaccacatggcctcttgacagtatagcaataaagggaacatgaattgattagaaaatgattccttcccgctgggacattagtctgtggaagactataacatgtgcgactttgctcttttatgctcccactcatctttaatcatgggcctactgggaacacctcattgcccctcattcactgggtggttgagtcttcgtgaagcaaacccacatgagttgttctatggaaggggagagcagaacggtgcattccatcattaaaatttcacatctaaacaccagtgcctgactatgctttctctgaatttcccatagggttattgaaagctctaacaaaacgtagttaaggcaaaagatagctgtctgttttataaagaatgtaaggaatttcccagtcagatggctcaaggaaaggctttacccgagcagtcctactttccatagcaaattccagttggttagagcaaacactgtgacaatatctattgttcaattaaaagtagccacaattatacaaaacataccaccatatggcatgtccttacatctcatgtatactgtagatactattttagcttcttgctttttctttttcttttttctttttaatttttttttattttgagataagagtctcactctgttgccaaggctggagtgcagtggcatgatcacagctcactgcagcctcaaccttcagggctcaggtgattctctcacctcagctcccaagtagctgggactacaggcatgtgccaccacacctggctaatgtttgttttgttttgttttgagagacaggttttcaccaagttgctcaggctggtcttgatctcctggactcaagtgatctgcctgcttggcctctcaaagttgggattacaggtgtgagccactgtgcctggcctagcctcttgcattttctatgggtgcattttcataatagctttttaaaatcaaggtagatcttagaagtgaaagaagatataagaattttatatattcttgagatataggaatctgatagtttcagttgtcataaagccagtggaaattcacagcttcaatgcgtacatcatgttgggaatttttctcctccactgtttctcatgagggtgggtttatagagttaaatagcaggggtatcttcaccaactccactgttggcattattttctttgaaaaaagtgtgcagagagatattatataaacaatatgacaaatcccttctccgtgggccaatttagtaaacttagagcagagaaaaactatagcttcttgctgctagaagtattacgcagaacacagatagctcttttcagtttcccataccgagagtcaggtaactgagtggtactcaattctcaaagcaacaagaaggctgaatattctggaaatccacaatgtagtagtaaaaatcaggtgactttggaactacatgaggaagaacaataaacaaattgctaattattccctgcctgccatcatttttatttactgagatttctattcctatctactttttgatttattgagattttaagggaatagaattttgggggaggttgttcagcaaatatactgtcaactcatatcattctcttgattttttatagaagaaattgaggtgcaaaaaggttaagtgctcagtattacattgttattaagtagtttagctggaatttgaatccatgtcttctcattccaaccaagagactttgttgactaaattaggctactctctatggtaagtatatgggcacaggtaggtgtaagagtacagttgtagtggtgttagtggtagtggtggtgaaggaagaagatactgctcatctctcctgataaatgcttacgagaatataaataacaggattattatgtcagttaagaataggcttacctgtaaacaacagttttctcacaattccagagttaagttattcagggttggtatggctcattagcattgtgaaaaaaagatctaaatatcttctctctttttgccgtcttcattgtgttggttgtggcttcatggggacaggatggctgctgcagttccagcaagcacaactgtgttcaagccatccatgtctttgctttcttgtttgtttgtttgttctgttttattttgttttgttttgtttttaagagatagggtctcactctttcacccaggttgtgcagtggtgtaatcgtacctcactgaagcctcaaattcctgggctcaagtgatccttctcgcctcagcctcccaaattactatgattacatgtgtgagccactgtgtccagcttcatattgttgcttctgataggaaaagctgatatttatctagagtccctaccaatctcttctgctttcatttcattaattatcgctgtgccatatgatcaccccagtatcatgggagtggctatctcccctggggctgggccctttgacttccccaagcagacagggttcagttaggctgaaaagggaggaaatggatattagacaggcaatacaaattgttgacacagttcctaatagaatacagtcaccctccttctacaccccaattcagaggtttggtttcattgtcaacagccaccatggttttatcctggtgattttgtcaagctgcagggaaataaaaggtagctgctctgcaaaaggtgacagaccctgatttactacctgatatgttgcttacactcctgtggtgtttttccagaaagaaaaatgaacctggccctagaagtctcactttgtggagcatatatctagcatgcaatactattctactatccctcctgtttcctcgagcatttcctgaacattcctctttggttattttattatttctctagaacatatataatttcagaagtcatctccttttatttgtgcctgttatccagtctttagcgtagctagatttgagccacccaaatgatggcactcttctttctggcacaataagcattttaagtgaaagaaagagtattagtagtctgagtggttgttttaaaactaaggttgactacataacaccatcccagatttaggccttgttgtgattggctttttcttgcactgagaaatggatatttaatgaccatctcactatgtcatagatgcacttccttaagttgaaaaggcctccaaggactcttcccaggagaaaaaagaaaatctgagttggagcttagcaacatccagttctgcatcaagcaggcctctctgctatgagaggggtcattgtttcaatcccctttgctgtggtggaccagcagctgtggaacccacccatgttcagggaccagcagcaatgaccaggaaccacgctggctgactcacacttaactgccctccaagaaaattcactataaaagaagtcaggaagttgaaaagaaagacggttttccttcacttagcttttctgcttaaggcttagaatcatcctgtatttgtctcctacattgaaacaacaaacctatttaagcaacctataaaatataaatagattttctgtagtgtagtcggtgagctttctcaggctgagttagtgtggcagctgccccagtttagcttctgcataggaaacaaggctctgctgaaaatgctgaaccccaggacaccctcttccttagtgtggctcagcacagatgcttgttgctttctgaaagcatccactgaccccatgacttagctgcctgaccctcctggaagtaccatgacacacttcacttttgttttgtctttttagaacttatgtcatcatttggggttgagcattttattgtgaaggctgcctagctcactgtggcatcctcagtgcctcctatccaatgcaaagtcaatagatatttttcaatttaaactggttttgtaagggaagccaggtatgcaggattaggataaaaacaggaataaggggacttctgggagcagttaatggttgaatggaaggggggttcaaggtgccatggctttgggtcttttctccattattttgagatgccatcatataggctacctttggttattcatcctattccattcccaataaatgaacacatttgcctttggcatatttgagcatgccctatcaaaccatgagagctttggtattaaaactctcctggtcggtgtccgggttttaccagaaagcactgactaagaaaatggagaagcatagttgcaggcctctcatttgtgccccatgagggagggaagagaaatgacagaagtctcacagctagagatctcacatctacttgtgtcccctttgttagatgtaaagccagccacatgagattacattcaccgtcggcaactcaggtaacggatctgaagggcagcttgttctttttttttttttgagacggagtcttgctctgtcgcccaggctggagtgcagtggcgccatctcagctcactgcaagctccgcctcccaggttcacgccattctcctgcctcagcctcccgagtagctgggactacaggcgcccaccaccacgcccggctaatttttttgtatttttagtggagacggggtttcactgtgttagccaggatggtctcgatctcctgaccttgtgatccgcccgcctcggcctcccaaagtgctgggattacaggcgtgagccaccacacccagccagcttgttcttaagaaaggaaagaatacaagccaaagcagagcaactatctttcacgggggctttcatagaaatgttttcatcggtacagtttggcaacatgacctccaaggacaagggcccttattccactaatatgagctatgatggcttagtggttaaaacctggagccaaaaagcctgggtgcaattacagaaccacactttgctgctagatggtgctgggaaaattaccaaacctctctgtgtttttcatctgaaaaattgggatgttaatggtatctatgtcatagggctgttaagaggattaaattattaaacaattgtaaaatacttagaatagcaatagggttatagtatacatgtttgttaataaattaccgagcctgaataaccaagggctttgaggccgactatagaaaacaatagagaaattgtagttataggatccaccaggtagatttcagagctggacaaaggtgaccaggcggtcagatggagaccttgggggaatgatcccagtgatggatagttgagatgcagatcaacaactgaggctgggcattctacaagtctgaaactagcaaggattgtgtgaagtttgtggatgttaagaaccttaaatttcctaaatatcatttattctttttgaaacaagatttgcctgtggaaatgctgtgacattttccaagctgtgcttcccctctgcaccactcatgacctcatactccttggcggcattttccaggtcttggtaacctcccttgaaaagagaaatatagttcagattcgcagcagtagtctaagccacacagctgctatgggtcaggggagatcaattacatttcctggggttctcttcaatgggcggtggtcttgtgcacacggcattatagatactcatccttggaacctggcttgttgaaggttctccagaggcaagaggaagttaaaagataaacttggctgtgtatatcctatttcataactgcctaaatagtaagcatgctgactggcaagaattagaactataataaatgcaattaaattgcctattacttgcataattgagaactataaatattttaaataataaaattgtgaaaaatttctctactaatgctctgggaatgtcttaaatctgtaaaggccaggggattcatagggatggctgaatatgaaatctttccattcatctctttgagatcaaatatttttcatgattatttcaaaaggctccaaaatggaaaagagtgaatatgtgagccgccatgagaaaggaagcccagaagagtgagtacagggtagtttttctgggaagatgtatttaggaaatggggcaagagcaaagaataaagaagtgcaaaaatagaactaatttgacactgcatatgtgtccttctccgttgctgtacatccttttttgcttccaaagggcataatttgatgtgattaaataaggccttctgctttaattaggtatctcagtccttgaaaattctgattaactttctgtgtatggaaggcaggagatatttaaatatgttgagagaaatacaagagcaatagcaaactaataatctgaagagaggtcctcttaacaggtgttttttttgttttgttttgttttttgtttttttttgttttgagatggagttttactcttgttgcttaggctagagtgcagtggtgcaatcttggctcattgcaacctccacctcctgggttcaagcgattctcctgccttagcctcccaagtagctgggattataggcacctgctaccacacccagctaattttttgtattttgagtagagacggggtttcactatgttggccaggctggtctcaaactcctgacctcaggtgatccacccgcctcagcctcccaaagtgctgggattatagctgtgagccaccgcgtctcaccttaagaagtttttaatactcgtacataaattcaaaaggagaagtggtatttgttctaatattttctataattcagttttaatatattggcatatccaagtgtgtttgtgtaggtctgtgtgtgtttgttagagagagagagagagaaagagaagaagaaggaggaggaggaggacgaggaggaggaggagagagattgtattattcaattacagcagacactgttagttttctgtgtaatacccacttttacttctttgttaacaatgaaatctcaattttatttgggatggaaatgtacccaggtgtgaaaaaacacatattttccagactcctttgcagctaggtgtcattgtgtgtcatggttctgggccatgcggtctaagtggaagttttctggagattttataaaaatttttgtctcttaatatgagcagttgccctgatttcttgtcctttcattcatcttcttgcttggaacttagcccatgagattgcagatggagactattacaatgaaaggcccatcctaaggatggcagacagaaataagagcaagtccagggcattaatgaatttgtagaactatgtcttcaaccgttatgggagaaaataaattcatatttgtttaagccactcatgttaactataatggtgcctacaagggaatgtataaagcaatagagcaagaggagtatcagcaattttcattcattaaagatctacttccaggactcaaataggcatgtcttatatttgatgcctattttggtggacatagccattttgaaatttacagagatccaacccatgctacaatacaatatttccatctttatagtgcttgagagtacatagatgggctgtagacaactaatatgtctgcatacactgtattcacttttggaataattctagtttttttgtttttactgagtagggacatcttgatagaaatttattaacaggattttgattttatgtaaaatgcatttaacttattttttatttgctgttttctcaatatcttatatatttagtattctatgttatattttaagggaatcttattggcacaattgtttttaatgctactgtgtataaaaaagaacacattttagaagcaaattgtaattagtaaaccaaccaatgttaaatgtttaagaaactgtaccagggaagaggacatagtacaattacagtagtactgacaattacggtaggaccacacatgtggatgccaatttatatttttacccactgcaacctctgggccaagaggtgaagttaaaaaccagtctctggctgtttcagagagttactactccacctgcttgtaaaattctgtctctttgaggtttttgccattgaactacctcccctgttatctacccacttctgcacactaactttcactgaccaaagactttcacttaaacccacagtcttcctttctctctattccaggccttgctgtcctcctgggttatttctgttttcatgtgtgcaacccattcagtagcattgactctcatttgtgggatatcatatcgttccatccataaagagttcagaatccacctccaaaagatagaaactccatgaagaaatagccaaaaagtagcaagagtctaaatatctatcagcaaaatgtagtatatttatacaatggaatattattcagtcataaaaatgaagtactgatacgtgctacaatatgagtgaaccttaaaaacgttatgctaggagaaagaagccagatacaaaataccacatagtgtatgattacatttatataaaatgtccaaaataggcaaatccatacacacagaatgtgtattagtggttgtcagaggataagggcagggggtaatgaggagcgactgctaatgggtatggggtttctttttgtagtcaaaagtgttatggaattaggcagaggtggtggtggttgcacaattttgtgaatatacaaaaaaaaaaaaccacactgaattttacactttaaaatgattaatattatcttatcttatgtgaatttcatctcaatgaaaaaggagattgagccagttatgttgctaagtttggaggaggtcaaagcaaataaggtcttctctttaccctcaaataactcatactgcgcagaggggacttccaatgggcccagcaccgtggtgtggcccagcctccaggagcaataggatttcctctcagatgaggatctgtgtaggatcaaggcagaaatctctactgaagtctgtttgtgtcacacacttgtgcatgcctgccttggagtctgagctctagctttgtcccagtcttgtcgccttctccaccatggggactttgcacttgtactcctttctgtgggaatcctgtttctttactcctcctgtctcgttaattcctcccaccttgcagattttagctcacgtgccattgccccagagaaatcttcctaccccgaccttcatagtcaggttcaatcaccaactgtccattctcttgctctcttgaaattctcctttgcaacagcttttaccagtttcccacagctgtaattctttcactcagttgtcttttcctgccagattttgaagttgttgagggtaggtactcttcaaaacagcaggcaaaggtagtactcagcccacttttgctcaccaacataacttcagcgcttcttagtgtctgacacgcagtaaggactcagtgaggacatgatgatcagctgagtgagtgtctgctactgtctacccagctacccaaagacatacgccgttagggacttccgagaggagaggtttttcccctctggccttgacaggtcctttcactgccacatcctttctcctctaagttgccatcatttgatcatcttatcctcacaggaacccagtgaggtagtttgatgccgttgtcatttacatttgaatcacctgcaatgcaaagtgaggataggatgactaaatgattaccgtgctcagggaaagtgtccagcattattttattgggctgttaggtcatgtccagtttgctcactcgaatacttcatcatattctgctgccaggcctataaatgtcaaatagtaacaacccttgacctcctggcccaaagctaagcatgttaccagatgagcctcactgaccttctttaatatgagaatctttaatatggattaatcatattataattatgtatttgttctttttattagagtccttggggaatgtcttttaccgaagaaatgttatcttacagggtaataagaccaaatgggcttttattttttaattaaaagaagatgaaaagttctgcttaaaatacttttaaaatgccttcatcttgaaggtaaatggcagacatgtatcattttgcacttatataaactttactaggctgggcaattgaactccaaaatgaggctgatagctaatagaacatttgtggaggagacaaacaaattgtccagaataaacaaagcttatgtttatttttaattgatagcagctgagcacagggaggtgtcattagctcaaggcacagatcaaactcattaagtaccctggccctcttataaatcatgcgacgtgtcgagtcttgaattaaaccaaacaagagaatggttcagaattcttcccttgtaccagcagaagcatggttggcacaaagacccttggagaaagattgagcaaggctgttccccttagtaacttctgagcctacgcagtgatcaacataggtgatttgcctgttcggagaccaagaattggagccaagtgactggttccgagtcctagctcctgcactcccctgccatgcgcagcacctgctatcggtaccttcccgttgcccttcagcctactcagggtgttactacccggctttttcacttgctggagacttcctgcaactcaggcctagaggtgttctcttgctgggaggttgtgctttgttcagttacaggcgagccagaaatgcagagttagccagctagggatgggagttggtgggtaaacacccttgctaaatcacccctcaatggaaaagttgtgttctacagagttcctcagagcacccccaacaggatggagcaccagcagccacagtggtaacctgttcactagtgtacactctcacttttcttcttcacagtgctttctgtaattgcctcccaaataagatactttttccaaaatcctagtctcaatgtctggttttggggatcccaacttgagaagctctataactgttccttttattcctaggacagtgttaaggaggctagaggtgggtagagaggcagcctagcacggtgcttaagaggacatgctctagaggtggactcgctggccacatcctgactgccactcactaggcacccagcctctctgtgcctcagtttcctcatccacaaaatggggtcagtgataataagagtacctatttgatgggcttgttttgagaattaaatgaatactaaatttatacttttgaaacactgcctatcacataataagtgctcaataaggtcaggtgtagttactagaatcacagaacatcagactggggaagaagtttacagattagctagtgcaacctcttcattttccatgtgaggcaactgaggatcaaagagacatggagtgatttcctcagggtcacacagctcatcagtgacagcaacaccccaaagtctctcagcgcagtgtcctccatgctgcgaaatcagcttcaggacagtcctacttccaaatactctgttaacaaacagaactcggtgtggtcatttcaatttgctgggctttttttcttaatttaggcaatgcaaggcaggaatgtgcaggcattatgtaagattttgaggagtccatgaatttaaaaccagaagttttttaaggggaataaaataaaaatcaacttcacaatgccataggcagaatgtcctcttgaagaatctaagatttagacacaaatactgtcttctgcagagtcctttacaaacttctgcttaacctcctggcatcaacggacgacaggttctggctgtgcagagtggaagtcccttagagtatttgacagcatttatctgataacagctcccagccttggtagtattcacttgtttatggaggtttgtacaagacagaataaaataaaaatgcatgtttctataccagccctttgctttttaaagtcttttttatctacggttccatgcaaagtcacatgttctcttcttccttttgatcttaaatgaggaaggggcaaagtgtgtgaagattccagaagaagtgaatcggagcaaagtcctcactaaatgaaagcttcgtcttccattcagccgctgagatcagtggaataaaaccacattagagatgatccccctggcccttagcctccagagagggcatctttcagtgacagtgaatgtgctgctatataaatacacaaagcattgtggaaaggaaagagctctgtggtatggagacttgtcaatatttgtccgaaagtcatgtttctattatcttcaagtatgtctggcaaaggaaatctggagggaatcttttaagaggtaaaacacgttgatttgtgaaaatgggatcattttatctcttctgcttcaaggtaagctctttggtttcacagtaactagttgccaccagatcaagttggggaatatttattcttttgcttcaattcctaaaagattgatattaatgcattaagcctctttttttctttatactttcttcttttctgcaactgataattaaagctataagaaaattaaattactattattattattagaaagctcccatgctagccagttctggttggatataggtcagctgtgtacaaatggacacactgtgaggctttgtgcaataatataaccactacttgagaccaaatgatgggtgatacatatcctaaacctctccctcatcatttttatggttaaattacaatgattgagcatcaagcttgcctaagatttgactactctacttctttgccttattttctgtatattaagttgcagggaaggtttttactttgcaatttatttttcctcttgaatagtgattatgtgaagttctaagcatcacaatgctgcagtgtataattcttcaaagcaggagaatcagagtgtagcaatggaatgcagaaaaaagcaatacgagaaaggattatttgtttgcatctgtaagaggataaagatggtttgaacatttgcttcatatggcactgatatgagcatacttacctcatttgaggtgaggtttccccagaagcagacagtgagaccagtgaatgcatgtagttgattttggaggtgatgctaggatgcactgataggaaaatgaggaagtgatcatgagaatggcaggatccgatacagttgcattattaaacaagttcctagaggagggctccatccccttgggattcttctgatggactgcatgagcacatctagaattgtccctcttgatatccatcacctttcttccatcacccatacacagccagagagtcacaggggcttgcaatgagaaggcactgatgtacatgggaacagtgagctttgaggggccacgggtgaaacatcaacagcgtgtgttaagctagaatgataactggctggttgaactaagtaaacaaatccaagtgcaaccttggaacctgggatattaaactggctgccaacattgggcctacctgttttctgtcttggtctggatttattcctcgtttccttttatttctttttctttaaaaaaaatcttttttccttctagtttctctataagattttttgagaatgcgtagatatacatgatggaggaataataaaaacactttaaagcaatagatgattcttaccaaacttacatggataaatgtaataggagacacaatttcagctgaataaaagccttactccaccactctccaaaccccagaactgttgtacagttagctttttagtacttacgactatctaatggatcttgacaaagagaaatataccatagcattgcattaatttttgagcagatagtatattttgtaattagatttaaaaaaacaatcatgtcttttgttgttaatgggttaccttccttcggtatatttgatgaatatcatctctcatggctgctcctgagtcagtctcttcagcaacctgttcctcctttgttactttgtttctgctcacaactttcagctccatcaacagtcatcaagtccatttggcaaatattgttagcctctggtagtggcgacaatacatagaggtgaaaatattctactgatataccactgtcatattaaactctatgttgcaatacaagcaattctcagactgaattctgtcacacacacacacacacacaaagcatcaatgaggaagtagccacaaaatagtcatccagtcttatcctgtaaacttagtgatgttcctccatctgcaagcacgcttgcaggaaaaccaacacgccttgcaggaaaagttcattttgagttgccaaacctctaggcaaaccaggctgtgaagtcacccattcaacatatgatcatgagaccagacagagctctggacctcggcttggctcccaagatcttattgccagaggctctagattctcatatatctcgtgcaagagcaatggtgccgtacaatctttttaggcaacaacatatcttgaacaccaatcgtttcaccaattgaggcatatttctaatatatcgtttgcttgttagctaaacttatgctattcaataataatagtggatgatgtagtcatctttggagggtgagtacctgattagaatattacatgttaattaattgccaccaggatatgtatttacacacacacacacacacacacacacacacaaagctgagagagagagaaagagatttttaagctaccaacacagaaattctttagaaatcatgatttacctttcctgtcaaaataatttgaaatttcctattgttaatctgaagtttcagtaaagagaattttattattcttcacatatagtatttctgcttttactgaaatggcttgctttaggaatttgccagaacagattttatctgccaatgggaaaaaaaaaattagatgttgaaagtcctgtttgttatcccgtcatcaaattcctcttttcaggtaaattttgaaaggttgcatcctgccagagagattttactgaattttctcatctgtctttgaaagctatactttatcctacagataaaactatgattgcatggatttgaacaagtcttatagaatcccttacatataatgtttagcctaataagattggtattggaattgtccccaaattatttagctagtacataatgctatatctataaattgtgataattttatgttttggctacagttgagttttagactctgtatgcagctggggaaaaagtatgacctactgggaagcatcagtgttttcttgcaagctcattcttcattttccaacccataatccccctctgctactcaaggaagctgaagcccaggattaatccatcggtgtccaaaggcctgcaggaggtcaggcgcagatggtttaatccttggtgctgcttggaatcatgggagtgggtgttggatggaagtgcctctgatctagctcttgctgtgggtgtcttgcacctcttgacacacctgtggctgcctggaggttgtcagcaccacccaccactctcctccctgccttctccgttgtttagaattcttgctatctagtgggtgacaaagaatgtctgaaaagttcagttgctaaatggatcaaaattagtttctcactagttctccaaaaggtgcaagtgctgttggaaaaagagctgtaaacaatattagttgttgctgccagttggagcctcataacaccttataattttatttctgttaatgagacacatgaggatctgtggagttcagtgggatataattttgcatatgcattattaaaaaaaagaaaaagaaaagctgacataagggagataaaagatcaagaagcgaagaatttccagctcatttaatagagacattgaatacccttatgcattgccttttgactatgccatctcttgtcaagcaattataaatacttgtaactaaaacattaaagcatagaggttaactaaacaaagcatcagcacattgcaggctaaagaaaacccttgtttaaagtgatttccattttgattaatttatccagataaaccatcaatttcccaaagttggagactccgtagatccagactttgttttctacgtgaaaactgacagttctctggaactgtagcagagaatatggtaccatttaaattatcgagactgtagggcaaaatttcaggcctcttaaagccagaaaaatggccccagtgagctctctcatgatcagttcattcttctgggaatctcaggaattactatgtctaatgactttgccagtgggtctggcctgtgtaattaagatctaaatatatctctatgttcattctataactaaatttcttatctggacaaatgacccatttatgaaagctcataaaatatcatagggagtcattacatacttaaaaatctctctaataaaatgtgcccaaagatggtcatatctgcattgctaataattttccaaaaatatgccttaccataagtaactagaaaatactgcatattatcattcaagagaagaaaagtagaataaagatccattagtattaaaaaagtatctttccttgctttaatttagcgaaaatacttgcatttttcttctgctctttcaattcctggatgtgctagcacagccaccatcacatcaacataatcttgcaagcttgtgcattcactgcagaaggcaaaatgtcatggcatttctttatgaaaatataaaacttttttttttgacggggcaagtttcgcttcacatcaaaggtaaatgagaatcaaggttgaaattgcaggcacttcagaattctgaatggaatactggagtgaccagactaaaggaaatacaccatatgtaaaggaaacattaactctggtattttattcccccttagtaatttccgaagttattgattagtagctctaatcttatgaaaatggttcattgtgtctcattaaggatgacttcatcttaccaaatcataacaaggaaggagtggaggtagagatagtagaggaggatgaaggaaggaagacttcccctcagttagaaactacacaagggagaaaagttatatgtgattggggagtgttatttaatgtttactgagagttccaagaatctttagtgggattttaaaaaaattgtaagttatctggtgatttatggttcaacctgaaggcaggagacaaaattcatatgtttgtgggattttttaaagttcataatggtctatgccttctaataatgacaaaattcttggaagcctctcagatcactgaatcatagtctttagaggtagttctcagaaatcactctatacagctctcaacctaagaagagccatttgcaattctgacaagaaacgataccttagcttttgtcttagctcacacagaaaagcacctgaccaattgacttcctcaccaggtagcatgcccatgctattatatatgtatatatgttaacgtacatgtggtttatatcatccaagtaaccgaagtcaaatggtcatttaatatagaattggaggcaccatagagcagctgagtcaagcctaaactgaggttatatatatcattagatttttttaagtacaaaagactaaaagtgcatttctttcacttttactgccacttggagttaagtttcctgtaatttgcagcataggacactttactgatataagggtcaccatcagtacagggatcagaattgtgaaagttcttagtttgaagaatcagtagtctaaaactcttgctactcagactgtaatcccaagactgtcagtattggtatcatctgggagcatgttaatcatacagaatctcagaccccaacccagactcactgaattagaattttcattttaaccagatcctctggtggcttgtctgcacatttatgtttgataattattctggctccaatttttggaatatattgactgtggtctaagctgtagacgtgtcatggacaggtagaaaccgataaaattgccccactaggaaacaattgagtctgtgataatgacactttatgtgaacagaaggacgcatgtgcttatcaggatgagaggagttaggtatttaaaaagggcagtattgttacaaggtacaagtatagagcacacgcttcatcatccagcctcttcctggttatccttaacctctgtgtagcttttgaagatctgccacttcaggtatccgtatacgtgaaaataataatgccctactccttgccttcccaaggttggaattaatgcaatgatatcatgaaagtagagcctgaagtagaattattttctatttacttgcttctaaatatgtccacagatcagtaacattagcatcacctgggaccctgttagaaacataatttcagcctgccccagagaaacggaatcagaatttgcattttagcaatatgcctaaatgattggatacacattggcttttgacaagtgctggtccatggcactttgtgaaccagggaactccctgtacctggagaagtttagatgatgcttgggtgagtcccatcaaaaatggtggagaggggagccatgtatggtgcatgcggaagttagaacaaataactacagggccagttgcaattctgagttagatatgtgttcttctagaaaaacactgaaacaaagtttaaagtgatctggagtggtcaaaggaataatttacagattttgcagctggatgtgagctagagatcccatgaagatatgttagttccaaaaggaacacattttgtagggtggggaaattttggtcagttctttggagcttgtgggaaatacatctctagtgaagaagtcttgtctaatcattggcttcttacttgtcctcaaaaatgttcctcaattacattaagtgatgtttgttactaacaaaactgtcattttccatgttgaaggatgtgtcccactttcagagaatcccaaaaattaaaaacagtggagggagaggaaaagtgatgggcagaaatccttccacacactttaaaggaatataacacttggctgtagtaagttttatctgagatagagttacaatctgctatggataatttttattttgttcatccttaatcaagatgcaatcataagattgtgatgaaaaattaaattcatcactttgtgaaattaaacttttgatgaagtcaaagtctagcagaactagtggcggctaaaagtattcatcaagtcaatacttgctccatccattcagctatccattcctccttccatcttttcttccatccatcatccatatatccatgcaataagtgaccttattacctttctaataagaatgacaatctagtgtatggactaagttaactccctaggagtagaaagaaattcactctctactcttagtgaatcctaggtttgtcacattttgcaaaaccaaatcttctcatctttatggtttgctcatctcccagtgtgggagccaaccctggcccgctagagcatttatttagtgaatggccagctgcttgctcccctccttgtggttgctggttggattaatgcagtgaacactgagaaatgtggagaaataacttacctcctggggcctgagctgtcatatctccttgcagactggctgctccccatcttgttctttttgctcatttccataatagactctggttgataaaactcttcactgtgattgatggtccacaaagcacagccattttcaggccacgagtagcaatttttaacttgggaaatatgactacaatcaatttctttctccttttcttttcttgctttcttttattttagtcatttctacagggtgtgtcctttagacatctctttcttggtcattattccctaattaattcccttgttaaatataaagtgtgcattagccttgactgatgtcttcctttgtgactaaggaaagaagaatttattacctttacgtattgaatcaagctgcataatcacaattcatttgtttaaagccctcattcttcataaaccatactagagtttaggccccctgcagctgccaagaggatctcacctgactttcataaatatgatatggagtcaggtgtttgcacatgtaattggtttaaaaagtggctgtattggctgggcaaggtggctcacgcctgtaatcccagcactttgggaggccgaggcagtcggatcacgaggtcaggagatcgagaccatcctggctaacatggtgataccccatctctactaaaaatacaaaaaattagcggggcggtgggggggcgccggtagtcccagctactcgggaggctgaggcaggagaatggcgtgaacccgggaggcagagcttgcagtgagccgagatcgcgccactgcactccagcccgggcgacagagcgagactccgtctcaaaaaaaaaaagaagtggctgtactcacatggaaacccatctcttcatttatgtaatgatttcaagttcacaccatgaaatcatggaggggatgaaatggaattgcccagtttgttgagagaacatgccgacacttcaagggataaaacagacgtgtcaagactctgcaggcgtgaaatctgcatatgcgttggtaaactagcaacctgctccttctccaattatgtggttctgtgacattagtaaacacagaaaaggaccttagctcatcccagggaagagagactgtgctggatatgagaaggatgcagtctgggctacaattatctggtgtagccatacaaaaaaagggaaaaaagctttgattagaaatggatagagtaatggttcgtaaagtgtggtcctgggccagatatgggggttcacgcttgtaatcccagcactttggaaggccgaggcaggaggattgcttgagctcaggagtttgagaccagcctggacaacacagcaagacctcatccctatgaataataataataataaatattagatgggtatgctggtgcgtgcctgtagttcccaactactggggaggctgagatgggagaatcacttgagtcccagcagtcaaagctgcagtgatgcatgatcgcaccactgtcctccagcccaggtgacagagcgaaaccctgtctcaaaaaaaaaaaaaaaaaagaaagaaagaaagaaaagaaaagaaaaaaaaaagtgtggtcctgggagccagcaacagcaatatcaactaggaggttgttcgaaatgcaaattcttgggctccaccgcagaccttctggatgagaaactggtagttaggccctccaggtgattctgatgcagctaaagtttgagaaatactataacggaggatatttttcttctgtttttttgggagaaagtcacactaatcttcagtttgaagacatgtttaaggctgttaagatctggtaggtggcacatagaacggttttcacactgtggatgctgaaaaagaattctcatctctaaccagttctttctcaaggaccgaggatgctcaagatgaattcttctctttcccttcttcccttgacctcactgactctgttctgcagtggaaagtgcttagaattctgagtcaaaggatcggggcttctgtctgagcttttcttcttaaccactgtgtgactctggggaggttactcacccagtctggggataagaataataataatgctttctgtcagtcttacttggttattatgaaagacaatgaagcccacggaagctgtagaatttacaaggtggtatctttcttcctacttgttaagctttaacaggggaagagactgatagctgaagctcctgagtattctgtccatttctatgatcttccagtaaatattgttgaatgtgtattctctctccctcctaacaactgttcagtttattagcagcctgtcagtgagtcccggaagaggatttgaggccaagttaggtgagaaatggttgattgctctatccatagcacctggcccataggttctttggaacctcaccactggagcctgttaagggttgggaactatttctctctgagaccgtctgtgttgctttgtgattggttggttggtgtgaatagattttcttaaaagcttctcctggaagttagaccttcaacttcctaattaagagacactggaaggtacaacttattaagaaaaccagggattgactcaaagccaaggatccataataacctccacttgggtttgtttaaaaaaccttcggaggcactggacacgtgaaagacagaatcccaaggaacactgccttcttcttaaggggcctctcactgaatcctttcccagttgtttgtccttggcagtccctcctgggttttaatccaggtctcaggggggcctttcttccttcttgtggctttataaagatttacctgcttttcctccttcttaccaagactagctggttataagcaagtgctctgtttcctctgaggttctgccaaaataaccctgcaggtttattttgctttaaaagctctactgccagccacaccaagggaaataacaatatcaaatgtcttaggttggtttcctcagaagcagactctgggataaggatttgggggaaagagatttatgacgaagtggtcccagaaaacacaacaggtgaaatgtgaagaagtgagagtgaaaggaagagtgggtattggggcaaatcccaggtgattacccaaggccacggggttgctctccagatggtgaaggtcacccttcaacattgtccccaccagggcaagggcaaggaatttgcaccctcccattcctcacccatcagtcattggtaaagggctgcccctggggagcatttgattcccgagctctatgtgcactataaaagttagttccagcatccaggggcagtcctctggcagttgctgtgaggggggcgtatcatggacaggggtgaatgggcttggagaaggatgaggcaccaactgtgtcccttagagctatgctgaggaatgctcccaggtgtatctgtcctccagagctcctgcaatcagccctgtgttcttgttcccgattcctgtgtgcaagaggcttcttcttgtcatttaaacctcttcttcagcccaggaggcccccctctcagggtcagttaggcctggcaatggccatgagctgtgggccttttagtctcgagtgggtaatttacttctcaggggatttgaaaagattgcctcttatgtcaattttcctcgggctctgcaccagcaaagtcacctaagggcgtccccctgcacttcccgcctcttagtgccaggtatgcagaatgtgcctgatacatgttccttaattatgaggaagatggagaggggatacttacaaaattagaggtgattaaggtcattgaagggtcaccatttggggaacattttcttccagtagaagctttcatattgcccaactgatttgccgttaatatgagcagggattttgttttgctttgtttttaatctttgtttcttccctttgcttctatataaagggagtttatagatgtaaacattctagaacaggatgcacattctcttgggtccagcaggtttatggagacctgttctccttttcacatatgtatgatttacagtaaaacattcctacaagtcacacaagcaagctcaggcaaaaatcaagttcttccatttgctggttccaacattttgtatcctaataaattcatggtgaaactaatccagctgtcttctcggaaaataaaaagtttgaaagagggctgctactattcatggccatgtaatagtttgttttatactgcatggagtcgaatagttataaacatgaaagcagctggcaataaatgactttacgacagctatttcaaaggtataatgaagaaaacaaaaagaaaccaagttattacttataattatagtgcctcagtgagttcgcacaccacactccaaacacttcactggccgtttctatgtgatctcatgcacagtctcctacaaagaaccttggcctttgggtcagttagccttgtgggtgggatgggcactgtaatagtgtttgcacttttgaatgcagtttttgaaggagacggcatccttttactatattcacccatgcgatggggaaaaaaattgaattattgactattctccactgttaaagagattttatattgaaaaaaactttaagaggagcaatttggtagtatttttaaaattttaaatgtgcttcttctttaacctaatggttaagtgggttaattttatttctaggaatagatcctaccagaatatattaggtagaaacatctagagtgttggttgtaacgctggatatgggagttcttgcctggaatcccagcactttggcaggccgaggcaggaggattacttgatgctaggagttggagactagcctagatagcatagtgagaccctcgtctttccgaaaacttaaaaaaattaaccaggcatagtggtgcgtgcctatggtcccagctacttgaaaggctgaggtgggaaaagtttaatagtttcagtttgaggccaaagtgagctgtgatagtaccactgcatttcagcctgggcaatagagtgccgtccttcctctaaaaaaaacacaagggtgcggtggctcatgcctataatcccagcattttgggaggctgagacaggcggattgcttgaatccagaagttagagaccaacctggccagcatagtgagaccttgtttctacaaaacatgcaaaaattaaccaggtgtggtggcatgcacctgtagtcccagctattcaggaggctgaggtgagaggatcacctcagctcagggaggctgaggctgcagtgagccataatcctgccactgcactccaacctaggtgacagagtgagactctgtctcaaaaccaaaacaaaacaaaaagaatatgggttgccaggttgcatgttacagcaaaatttacacacagcctacatattcatcaatgtggcagtagttaaataaacatagtataatcataccatagactagaatatgctattagaaacatatgaggtagatcaatatacactgacattgaatgatctcctaagacctactacatgaaaaaaggcaagttccagaacataaaaaccaatgtaagctccaatttgtatagaagaaaaatatggcgatgcttgtatagatcttataacttaatcatttattcatttatccacacaacagatatttattgagttccagacaccattctaggtgctggtgatacagcaataaacaaagcaaaggtcttcctgggagtttgcaactcaggaaagagggaattgatgttggggagactgtgaacaagcaaacaactgtgtgtcaggtggtgatgggagttgtaaagagatacaaagcaggctaagcaatagagagtaatttagctggaggctaggaagacctcttcgaggaggtgacatttgatcaaagatctaaaaggaacaagggagaaaaccagggagtatttgggaaatggagtatgccagacagaggtgacaacaaggtcagtggccctggagtagaatcatgctttgtgcacttgaagaacaaaaggagaccaatgtggctggaactcaggagcaaggaaaaagtggaagggaggggctaaggaagcgaggattggaggttatggttgtgattttgaattttattaaagcatgatgggaggtgattacagggttgagttgaggaagaggacatgacactatttagtctttaaaatgtaaatgaatgcagcggaaggattctcactctactcttggcagtgatggcctcaaggagggtgttctcagcgaattagaggagagaaagcgtgtggctgtaagagaactgttctcactgagatctgcctatacctgtcttgttttagccttgtattcatgtgttatttgtgtaattaaaaaatagaatcaattactctttatacgagataaagaaatcctttagtattcctttctgtgaccttggacaagttttctttcttagcttttctcttctccatgtttatagaaagtgggcaatctgtttttgatcacaggcttgttcatgggaatgaatcagataatgcacatagagctctgagcccagtgctcagcacatttcggtaattcaagaaatgacaacaattattgctgcagtgctgctgcctcccatgtccaaacactgtgaggcattcaggatactataaaattgcctgtctctctatcacctttatcttgagctatagagaaggataagaggctgtttcatagcatcacagaatttaatagccaaataagccatctagcccagctctgctccttttatagatggggatagagaggtgctgaggggatatactgttggctcccagacctgtagctagtgagtgacctgtgcttgtgctttccatgtcaaatctttatttcctgcattggtattttcctaactttggtcatttacattccatcttctggtttacctaatattctaattgactctttaagcaattttattttcaaaggaaactttgtatcattgtcataaatggaaaacaagcattacttgttatgatagattataataacttatagttttagcatagttatatcattgccattactacagtaatgctatataaccagcactcaaaaactcagtaatgtgcaatagtaagcatttcttgcttacatggctatgggttggttggggcacagctgatctgagactgagtttactacatctactccacttgtctgtcagcctccctggaccagtagctacatgaggcgtgttcttatggtatagtcttctcattgttctcctccaaagacaggaatttaaaagttgaaacctaaatgtcacgtccattattatcccattggccaaatcaagtcacatgctcaagtctatcatcagcgggatgaagaaaaatatatcccctctgtcttagtcagctcaggctgctataacaaataccatagtctgagtggcttaaacaacttatatttctcacagttctggaggctgggaagtccaaggtcaaggtgccagcaggtttggtgtctgtcaagagctcttttcttggtgtgtagactgctgtcttctttctgtggcctcatatagtggagaaagagataatcttcctggtgtctcttcttataagagcactgatcccattcatgagggaagggctccacccttatcccctaattacctcccaaaggctccacctcctaatgccatcatattgggaattaggtttcagcgtatggatttagggcatggacacaacattgcatttatactactcccctcgtggagtgtcttactcggttcgggatgcataacaaattactatagactgtgatttaaacaacaagcatttatttcttacagttctggaggctgggaatctaagatcagggtgccagcatagtcagattatggtgagagccctctttcagggctcaagttgcagacagccaacttatccttgtattctcacatggtggaaagaagagctaggtagctctctgacctctaatgtcctctagtggcactaatcccactcatgaggcctccaccctcatgacctaatcacctcccaaaggccccacctccaagcaccatcacagtgggaccagagcttcaccacgtgaatcttgtgggggacacaaacattcagtctattgcagaggaactgcaaaattatatggtaaagggtatgtgtagaaggagggatgaagacttgggaaaaatgtaaatatcacatttaaatgggtaatgtccatctgtttaccacctcaaaatatctttcatactcctagagttaggcataccatggtttgaaaatgctgaagtatatactgcaccctagttaacggcatgatggcacaacccactatgctgataaccaacatgtagagaaaagagtggggccaagcacagtggctcatgcctggaatcctggcactttgggaggccaaggcaggaggatcagttgaagccaggagtttgacactagcctgggaaacatagtgagacctcgtctctacaaaaaataaaaacaaattagccagatgtggtgatgaatgcctgtagtcccagctacttaggaggctgaggagggagaatggcttgagcacaggactttgaggctgcagtatgataggactgcaccactgtactccagcctgggcaacagagtgagaccctgtctctgagaaaagaaaaagaagggaaagaatggtattctgaatttcattgtttctaagatgcacatgttctcatattctaacttacttgaactaggataactcttatatttgaggtgttttacaatcacacatagttgtgatgaagcttctctgcctatacacatacacacttggttgtcatttctggcggattggctgggcaactgccatcccttgactttcagctaaccaaccaattaggggccgcctgaggaggaggtatgtgtcttgactgttgtctgaaaccctttgttggaagctctggcatgaaaaaagaaagagctacgcgcaaaactttcagagagggtggcagtggtttggaagaaaagtgcagagccaacagtgggtcagtcattaaggactggagcaacaccatcattcttgagggtatgaggataaaactgtggaaaactcctatctatgactctgagttgaaaagtgattcataagtactggatcctgaatgtgaggaagttttaggaaacaaacaatttatctcctttttatccatgctgtagaggaagatgtgcttaaaaattatctacataaatcaacaatagcaatttcaatgagtatgcaatgaaaatcctaaatgataagaaagcatgtgttatattttaactggtggagctttctcttcttagtggtccacaaagtaacacaaaataatggtgtttcttacaattgacagcttgcttgagtcagtgaaatgtgatatataatgaaaaacacttaaatggaaggtatatcaggtagcatggttttgcttgcaaataatgggaaatctaactaaaactgactaaacagtaaggaatgtgttggctaagcaattgaaaaattctagaggttaagagcactttacagttaatttacaccaacaggtcaatggtggtcaataaactcttcatctttctattcttgtggctatggaggggaaggtatgctgcttatttaggtcagtcagccccttccgatggagctgaaggtggagtcatttctacccagactgcaagactgctgtgtaaaagtggatgggatgacgatggatgagcaagagagaaagaaattcccactttgcaagaatgcctaaactgagaatcaagggtcagagagaagcaagtggtagggatgatggcttagggtttattgtgtatgttttgagacactgttagggtcaagacagagaaggctgaggagcatttccttccttacccttaaattacttagacagaaagggaagaaatgaagacggactttcaagggaatgggagacagagtctacagccttaaggatttcagtgcttttcactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaggatttcagtgtttttgcaaatctgcttgatatcaacatgttgggctataaaagtatttcccacttggtggcccaacctataatttcacataagaaaaaattctccactcttaagtcaaatttatttttatttttattttttaagacacggtctcactcctgtggcccaggctggagtgtagtggtggaatcatggctcactgcagcctcaacatcctgggctcaggtgattctgccacttcagcctcctgagtagctgggactacaggcatgtgccaccatgcccggctaattttttgtatttttagtagaggcagggtttcaccatgttgcccaggctggtctctaactcctgctctaaagtgatttgtctgcctcggcctcaaatgatttttttttgttttttgtttttgtctccctagaatttctgatggctgggtgctcaggcctgattagcatggagacatattgctcctgaagtttgctgaaaggagaatctggaggctcacaaatttggttgctaatgtcattctccaaattctagaggtgattgctgagttatgtgcaacacctggcatgggttttggtacaatttatcattcctccatgggatagtatttgcatggaaggtggttatattaaatgcagctttgaaataaagaaatctcatgctactcacttctgatggccccatcagaagtttattatggcagagaacacaaactatgtgctgcaaaagttgttagtttgcttgttcacttgctctttctcaatctctctctccctgtctctctctgtctgtctgtctctctctctctgagtaataaaaaatgattaatggagtaggcttagtttagatgaattctgtgcaaagttattttacataaaatgaatttttttccacaatactctatttccatctctgctttatcattgcctttttgtttgaattaatgcaataatattaccaaagtcatcctccattacactaccatttgctcccacattcaaggcaacgatgtcatttccagatgaaactatttgtccttgttaaaacagacaaggcagttggtacattcagactcaattactaagttgcatgattgattccaagacagaactgagagctaaggcaaatgaaacttgtcattaactgtgcagtatgtttttcttctgctagatctgataggagaaagattcacatagctggatctaagagggaagcgaaagggagttagcccagatcagttcccagaaaacagactctaagacagagtttagaatgctagatgtttattaaggagtgcccttaatcaatacctggggaagagagagagaggaagcaggagtaggctgaaggagaaggtgagctggatgtagacccaatgatggaccctacagacacagtgaggaactctgaagctggaaggacccttcagtgttgtactgatgagccaaggtggccaggccttataccacttcattgatcagttactggtgtgaactgtcctgagcaggagcatgattctgggtgaggtggctttttatagctgaggcagtccttgaaaatgttgatagttgaaggctgtctgctgggttctaggtcctagactcaaggtcagtgattctcaacaaggggtgattttttccccctgggaacatttgacaatgtctagaaatatttctgattagcacaactggagagatgctactgatatctagctggtagcatccaggggtgctgctaaacttaccacaatgcacatagcctccaagaacaaagaattatctggtccaaaatatcaatagtgctgaggttgggaagccttgctctggagcaacagaacctggtggacatcacagcatccatgccaggagtcatcactaatcaagatattactacttctcagacacaatgctcatgttctttatttctcttactccttctacaaaccctttgaggcaggcctcagagtttccatttactaaagaaaaaagcagtgctcagagtagttcagtaaactgacccacgttatgaattggaaggacaccaagatgtgaattaaagtgggccatcttgttgaaaacattttgctatcttctggctttccctttgaaagagttcagaacatacaacccaaaaatgtgcccctctggcacattgactattttgagtcaaaggcacgtaaaaaaagggcaggtgcaagaagaacactcttgcagtcctttttaaaagcaggagataaaatttccagttgaaatatatcctccctgtactagaagaaaagtgtcattcttatcatcaaggatgggaagttgaggtcactggaaatctgtccaaacacaccttgttaaactaactcttgtctttcttatcacttcacccaattaactaccctagcccaagcccctttaccttgtcacatcttcataatctactactctttgtccaatttagtatatgtgtttaactttaactgcatctttcagtcatcattttcttatgaagcctccaatgccacatacaacttgaattaaatacatttgtattgtattttttttcttgttgatctgtcttgtgtcaatttaattatcagccacaactgaaaaactctaggaaggtagaggtaaaatcttgccttccctacaccttgagggctcaatgcagaggttgtcaaacattttttttttctctccagacatgagatacatgatgctcacatgttcagtttgctcccatggaattcctggggctcaagctgtaaactcacttttatcctacttaaaaggtacagtggaacatgactggcatggcacaaatatggggatgaatctgaatcctctctgatttgtatttttaagtagactgttcctgaactctgagtcctttctaatcgtaacaaatatatagtaagcttgcagttgattttcatacggagagtaacgcctattgatagtgttggtgaatgcctgtaaagagactacatcactttcagagtctgtgttacactgttgcttcatgatctgtatcactgaatgattaagtcatttaagaacattcttcagatgttattggcacctcaagaaccgtcagaatcaaagcattgactcataaatttaatttaaaaagagcagctactatgttccagaaactgttctactttctcattataaacagtagaattcactattaatagtaaaggcttccacaggagcagaaaaaagcatatatcattttacagacatacagttgagcttaacaaagtcaatttgtactctctctgaaacaaaatcacataaattttgacgtttttaatagagcatcatgcaaagggaataaacaaacataggctatgcaatagtgttaatagaaataaaaggcagtacacatttagccaaaagatataaacaaaaaggacttagatcttttattattattgacctcaatagtaatgttagttattatggtccatagcagctgcagtttttagattctagcatagtgccagtaacttaaaaaaaaattctgtcattaattccaacagcacatttcttttttcactttttattttatagatttagggggtacaagtgcactgttgttacatgaatatactgtgtaatggtgaagactaggcttttagtgtaaccgtcactctaacagtgtacatatactgtacccttcaggtagtttctcaccccttgcctccttccacctttctgagtcttcaatgaattattctactctctatgtccatgtgtactcattttttagctaccactaaaatgagaacatgcagtatttgtctttctgtgactgagttatttcacttaaaataatggtctctagttccatctatattgctgcaaaacacatgatttcattcttttttgtggctgagtagtattccacctaccatcttttctttatccagttctccactgatggacacttaggttgactccatattgttactattgtgaatttgtattgtattttttttcttgttatagatagcactgtgataaatgcaggaatagaggtttttaaaaaaataataatttcttttcctttgaggagatactgagcagtgagattgttggatggaatggtagttctatctttagttctttgagaaatctccgtactgttttctgtagaggttgtactaatttacattcccaccaatagtccacaacacatttctgtatggtgggcattatcttccttttacaattgaaaaatacagaccagaaagagtaaaacagcttggttgaatttacacagaaatcccttggcagagaaagttgccatacccagaccactttctatagctagaaagcctaatttagagtaaaatgtacatttatatttgtcaattcatttttttcaatcaaattctctgaacactgctaagcaaaatatggcataagcagtactgtgctggtaaatgtttaaagactggctgtcaaaaaaggggtacatattatataagcttcttttaaattgtactgacataaagaacatgtagcacacaatttacatataataataaataatatatgtaatactctttattatacattctaaatagttttttgattttcacagaatgcttttgttgaattttacctaaaatgtgtatcaatagccagtctgtggttttaactgtcccacaatatgggtcatgaatgttaattgatgttttcagattttaagcaactgatgtgacatcaggtaccatggagctggaaagagagacttgtgtagtattttaccatacacatacgacagacacacataatctcaagagcataggtaatagtcaaatgtgcaaagtaattagaaagggatgagttctgactattggttatctgtgttttgatataatttatttcattgtaggtttatataatttaatttcttaataataactttaacaattgcctcacaagattcctgaaaacttagcagttggttctcgtgagctgatgtaactgctgatagggaacagttaccagttaatcaaatatccccatttccagtgtcccctactccaactcatagctctgaatatgtaagtagagggcatcccattatcaaacaaaatagatgttgagaaagatgatgttgcgtagagttgtttctttaatattcattgttatttttgtggtttattcacaggcatttccctgcatctcaacaggcatttatggtaagtgatacagcttttgatgatgtttgtatttctttattttgctgttaaatgcagagattcagtgaaaaaataagaggttctctgatgaatatattttgctgtgatttagagactaaaaatgctcgtcaaatcccattaaagaatgtcatgaggctattcagattcttttgggttcttgaatttggttatatcgggtatcacatgaaattatttgatacattgtggcttgatgtcttttgttaaacaaaaaatttggttccagtaggattgacttctaatattgctttgtttaatgaaatcaaatttcttctcagtagaaagcataatgtacatagagtttagcagtatcattattttgttgctatttacaaaataatagaaaaattaaaatgcatacatatgcatatatctgtgttttcaaattttaaaaaagtccaaagaagtgacttttactaaatatgaagaattttaataaactgcaaatttttttttctgcatagtgatggattgtgttaagtagtgaatgcctcacttacagatggaagcaaaatgtttcttaatcacttgctttcactagcctaaagctctctaaatattcttccacctacctacaagaacttttttatactttttttcagaccattaataagtctgttttataatgttaaagattttctgatctaagtgaaatagattacattctttctgaacttaaacttctcacatggaagctgtcagctgaagcacaaaatatgtaaaaatctaacatatatgtatatattttaaattcattattacaatgaaggactacctagattgatgtcaaaggtaggagctttactttttttcttcatctggtatttcttttgaaggtcttgagcaaaataaaatgagaaatgtaggcctgaaccaaattaagtgggaaaggattttgtcacactatttaaaaatttaaggtttcctccttcaatttaagccttcttcctctccagattcccctacagcctgtctttgtggaaacaggatgagcactgggctggagggggctaaactagaccatctgcacaattatccccatcatggccattctttctgcctcacaaatgcccaataacaaaccttaaatatttgcttaaaggaagtattatgtacaaagttatgcctggcaaataccctaactctttatttcgccttatgtagagtcaaaccaaacttcattgcagaaatggtttttattatgaaaatgttctttcattgcaatcttgattttccttgccaaaaaaacaaacaaaaacctaatgcctacaccaatactgtatacatcattttctatgtttattaccttgtcagagagttgaagtatgttttacttctgagaatcttatggtaatgtgttaagagcttcaaaaagggaattgatgtaatatatatggtatactataagtaggggggtggtgggaaaggaaaacagaaaagcaaaggaaaatagggaaggaccataaaattagaggctccaatatgatcatgtcaatagatgcagaaaaagcaattgataaaatccagcatcctttatgataaaaaccctcaacaaaatgggcatagaagggacttacattaaagtaataaaagccatatatgacaaaccaacaaccaacatcatactgaatggggaaaagttaaaagcattccccatgagaactggaacaagacaaggatgcccattttcaccacttgttttcaacatagcactggaaattttagccagagcaatcagacgagagaaagaaataaaaggcatccaagtcaaaaaagcagaagttagactgttgctgttctctataatatgatcatttacctagaaaaccctaaaactcacacaaaaagctcctcaatctgataaacgaattcaggaatgtctcaggataccaaatccatgtacagaaatcagtagcactgctataaaccaacaacaaccaagttgagaatcaaatcaggaactcaatccctttcacaagagctgcaaaaaaaaaaaaaaaaaaaagataaaatatttaggattatacttaaccaaggaggtgaaacatctctacaagacaaactatgaaacactgctgaaagtactcagagatgacacaaacaaatggaaatatatcccatgctcatggatgggtagaatcagtattgtgaaaatgaccatacttcctacagattcccatcaaaataccatcatcattcttcacagaactaggaaaaaaaagctgaaaattcatatggaaccaaaaaaacagcctgcatagccaaagtaatattaagcaaaaaaaaaaatctggaggcatgacattactcaacttcaaattatactacaggtctataactaacaaaacagcatggtactcctataaagcaggcacatagaccaacagaacagaataaagaatccagatataaagccaaatacttacagcaaactgatcttcaacaaagcatacaaaaacataaattggggaaaggatatcctattcaataaatggtgctgggaaacctggcaagccacaagtagaatgaaactagatcctcatttctcacctcacacaaaaatcaactcaagatggagcaaagacttaaatctaagacctgaaaccataaaaattctggaagaaaactcttctagacactggcttaggcaaagaattcatgactaagacctcaaaagcagatgcaacaaaaacaaaaataaataattgggacctaaattaactaaaaagcttctgcacagcaaaataaataatcagcaagcagacaatccacagagtgggagaaaatatttgcaaactatgcatctgaccaagaactaatacccagaatctataaggaactcaaacatatcagcaagaaaaaaaaaatcccataaaaaatgggcaaaggacatagacaattctcaaaagaagatatgcaagcagccaacaaacatgtgaaaaaatgctcaacctcactaattatcagggaaatgcaagttaaaaccacgatgagataccaccttactcctgcaagaatggccataattaaaaagtcaaaaaacaatagatgttgtggtggatgtggtggaaagggaacacatttacactgctggcgggaatgtaaattagtacaaccattatggaaaatggtatggagattccttaaagagctcaaaatagaactaccattccatccagcaatccactactgagtatttatccagaggaaaagaagtcgttatatgagaaagacacttgcacatgcaagtttatagcagcacaattcacaattgcaaagatatggaaccaacctaaatgcccatcaaccaatgagtagataaagaaaatgtggtatgtatataccccatggaatactactcagccatgaaaaggaatgaaataatgtcttttgcagcaatgtggatggagctggaggccattattctaagtgaagtaactttagaaatgggaagtcaagtattgtatgttctcactttgatgttagaactaagctatgaggatgcaaaggcataagaatgatatcatggactttggggacttgagggtgacgggtgggaggggtttgagggatgtaaaactgtctgttggatgcagtgtacactgcttgggtgacaggtacgccaatatctcagaaattaccaccaaagaatttttgcatgtaaccaaaaaccacatgtacccccaaaaatgttgaaataaaaatacaatttaaaaaagtttaaaaaggcattttacttaatcactataatacaaaaaagcagaagaaaacacattttccaatacagtagacataacttaaaaatattcaagtatctcatgagatctgtggtatatttatgtatctataattcattaacaattcatctttcacttaataataatatttatttgttccacacacaatgtaataatttaaacacacacacaaaagaattgttagatcatattatatggacatgtttaactgtattgtgaaataccaaactgttttctaaagtgattgaatcaatttatactcctacccactctacccactccatttgaagatcaccatgttccctgtcctccccagtgtttggtattgccagtctctaaaattgttgccaatttactgagtgtgaaattttatcccattgtggtttaaatttgcattttcttgattattaataaagtaaactttttaaatatcaaaaacaaaagagtctccagagtggacagtaagaactaactaaaatctagagtggatcatggtccattttaatctgtgaagaatagggatttcaccctagagagagtaatgtggttcaaaatataataactgattcagtacaccattgtggcgaatgggagggaaatagtgaagattgtcaggcatggcattaatagtgtgagtcacattagctggcttggagggctgtcaccaggcaagtttagtcattttcacaatgctaggtcaaagaaaatacttcttcagtcctggctacttgtctctttctcctctgttttttggtaaatttacaagtgagactgatatacacaaaggtcgcatgccatattgcttttggttagtccccctggggttgaaacctaactttccttttagcttcataaccttctgtttcagtaactttagattgctatgtctctgtggtttatagaccattcagcattatgcaacttgaaaattacttcatatgtcctgcattagtccgttttcatgctgccgataaagaaatacctgagactccgtaattcacaaaagaaagaggtaattggactcacagttccacatggctggggaggcctcacaatcatggtggaaggcaaggaagagcaagtcacgtcttacatggatggcagcagacagaaagagagcttgtgcagagaaactcctgttttcaaaaccatcacatctcatgagacccattaactatcacaacaacagcaaagggaagacccacccacatgattcactcatctcccacttagtccttcccacaatatgtgggaattatgggagctacaggaggagatttgggtggggacacagagccaaaccataccatttatggtttatagaccattcagcattatgcaacttgaaaattatttcatatgtccctggtgaagttacagctttctcagtccttgcttctttcccaggatctgtgtattacagactagttttcttgctcttatttgaagccctcttcctccttcattaaccagataagttttctttcatcttttttttattagggtttgacgtaatattctatttaaagaaagtggtccatagctgaaaagaaaaattttacaaagcaaacacaactcccaacatttttgtaagtcatactagaatggaggtagagaaggtttttagaatcatttcctggtggcactctttttctttcttgttccatattccaaatctcactagaattgtttttctaaaataccacttggtgcgtgcttcccatctgcccaggagcctttgctcatattctattgcttgcagattgatgttcactcttcctagcctgaacaatgggcactttctatatctccataaactagtgctttcaaaatgtgtgagagggagggaaattggtgtgctaaggatgtaaattggtgtgctaagaaatttatatatgccttttcctttgcatctttaaaagggggatttaatttatggcagttcttaaagttatttgatgatagaaactagtatatcctcaacatttctctggactatgttttcttcagaatatagtttgagaaatttcttggtacccattcatcatggttatatcttctgtgacccacatgtacatgatctgatgaatataagaacttgccattgcacagtgaggtccaatcttgggtcccttcctgaaacttactccttaacacctcttccccaatgcacacacaccaaattcgcacataccatcaccaccagtgttgtctatctcatgccccaaacagaaacatgccaagcacatttaagcagactgaaacatttttaaaaagttttattttaggtttgggggtacatgtgaaggtttgtcacataggtgaacttgtgacacaagggtttgctatacagattagttcatcacccaggtattgagcccagtgcccattacctttttctgctcccctccttcctctcaccctccaccctcgagtagaccccagaatctgtagttcccttctttgtgttcatgagttctcattatttagctttcacttataagtgagaacatacactatttggttttcttttcctctgttagtttactaaggataatagcttccagctgcatccgtattcctgcaaaagacataatctcctttttttttatggctgcatggtattccatggtgtatatgtaccacatttcctttatccactctgtcactgatgggcatttaggttgatttcatgtctttgctattgtgaatagtgctgcaatgaacagtcacatgcatgtgtctgtatagtggaacgttttatattccaacaaaaattagccatggtagtgggcatctataatcccagctactcaggaggctgaagcaggaggattgctggaacccgggaggtggaagttgcagtgagccaagatcacaccattgcactccagcctgggcaagaagaacaaaactccgtaaaaaaaaaaaagaatgatttatattcctctgggtatataactagtaatagaattggtaggtcaagtgatagttctgctttgagctctttgaggagtcgccatactactttccacaatggttgaactaattcacactccgaccaacagtgtgtaagtgttcccttttctctgcaaccttgccagcatcagttattttttgactttttaagaatagccattctgactggtgtgagatggtatctcaccgtggttttgatttgcatttgtctaatgataagtgcattgagctttttttcattggcttgttggccacatgtatgtcttcttttgagaagtgtctgttcatgtcctttgcccactttataatggggttgtttgtttatctcatgtaaatttgtttaacaggctgaaacttgatctgcaggaagtcttccttaggtatgccaacccttggtggtcattatactttctgaaatttttttagcatttgtgtcaggacaattatcaactgcttcctcatgttgctccatagattgctgtttatatattctgtgctcacagccagtttggaatttaaagagcaggaattcacttctgcatatcctttgcacacccagtgcctagcaaagcactgtgtctctaggagaagctcagcaaatatttggttcatgacagcagtgattgtaatccaaattgttgcctaactgaagatatagaaatcagaattcttgattggcaaaataacaggtaaagaaagctacccagttggtattttcttaatgggcaaacatttctattctaggaaaaacaaatgtgtttttaaaaggcattctcaaactggaagtttgtatttgtaggtatggcagtgtccaccctgtcaaggtaaaatggaaactcaagaacttattcagttagagagccaaactaaatacagcattttacttcagttaaaatagaacccctttgtggtttattacagcccatggaacaatggtcactcaggaacatacaggtcagctggccatccaggaggccctgttctgacttctccgaatgtaccccagacccagcccatctctccagtagctgccatttctcacacacctgtttgctttggagttaccttcacttttagatttatgccccaaaagtccactgtaatcctagttctgctataatgaaattttgaggatggcagagctacctttcaaatggattttgttatttaatcactgagattattttataacaggataatttcaagagtgagcatacccatttcctggaaactcggacctcagcatcacactcacagtgtgtctggaggacctggccaggcgccagtactttgggggtgctcaggaccctggcagctctcctagctttctctccctctgcagccctatagccacaaaccatcaattgcagtgaaaccaccttagcctttttgtaaggcacagcctgaggaatatcctccatgtgattaacctgatttaaggaggagacaggatgagagcagacactgccttctttgaagttcccctggaagaggccagacttttccactctgacattcagtgagcactgttgctactccaacgtgacgtttccaggatggttccacagggcaccagaccacctgcttacactcaggatgaaaagcctcgtttggtcaaataccaaagaaagccctgtgctacttttggaaaaatagatccagatgaggctttcagggcttgaaatccctagattcctgttaaaattttgcactggcctctaaagcagtctctaaacagatctgaacctccctgatggacatttcagatctcaggcgtgctttctgccctttgagccctattttgacactctaatgctaataaatttaacaaaagaggctagacataatacatggcaatggaatttttactgagaagtgaatggcaaaaatgattttagtcaattttatgagagtcaatatagttaacagaaatcgactcctggctgaaaagtgtattccgtgagtacttaaaaatttggaaaatattttccctggaaaaaaagaaaaactttgaagtttgctttccaggtatgacgtggcatatgtagagaggaaggaatttcagacattgagttattggctgtaaatgtgaggaaaaattgaagtgcagcatagcttagctgaagcagctctcgtgtttatccaatatagttttgttatcaacgtggagtgcctgtttctatcagatcacctggtctctttctgctatccaccacatgctggcaggctgcaactttctaattgaatccctcatttgcattcaagtttgctctgcttctaactggtaaaaaggagaccagcgcaatgttatgttaaccttgtatctacttggcaaatatttttatcagtacatctgtctagagtcacagacatgacttggaaaaaaattagggcattctccaacggcaatgccaagggcatgcccttcatcagctttaaatgctgacagatttgagaaggtgtgacaatcattgctgtgcatatttacagaggaaggaagagttctcttatgtaatgcattgggaaccagagcaaaactgacaaaattatgcaccccttccttttatcaccctaatggctctcctccttcctttggcttttttctcttccctttgatatttccatttgctttaaaaacttactctcaggtggtctaatgatgactcttttcactgtcgtaaaatctctgctctggcaacctaagttttttatcttgtcaaattattcccactgtaagaaatgttatcattcttggcaaagcaaagtaacattagaatcagtgtaacttacttcccttgggaaaatgcagtgctggggccaagcctatctctatcatagctcgtttgaatatcactttatgagctaacacttttgagacagtggagagacaacttgacagacagcaaaattctggctattcaattgtttctaaccctgagtgcttatcatttggacagacaagtttagctaacattctcattcacagaaacattgatacatacatcccagaaaatatggtacagactcctctcgtgctctccataccctacccacgtctttaatattaaaatgacatcaaactaagaacccaaaggactaacttcactctggaaagtagtctcaagtgaccaactacaaaatatgctagttcagtgtacataaaaatggcagtgaaacccatgggcaggattcctctaggggacctgacaaaagagatgaaaatcctggaaacttagtttttctggaatgcagaggcagtgagaaaccagtgtcagtcttcctgatgttctgttccagatgaacaattttgggacttaattaaaagattaagtgtttcactatgcaatatatgcatggaagaaacttgtatgtgggccctctaattatataaaaataaataattaaaaaagaaaacaaaaattaaaaataattaagtgattcaaaaagtaataaagatcacaactgtctgactgtttctggggtttggatgtgcactcccttgtagttgtgtcaaggtaaaagtgattgaagcctggaaggcatcactgaattcccacccaccccttcctcagatgtatcacttattgttatgctataatttttaaaaaatgattttctgaatagacgaaacattgaaacagtaagccttttaaggaaatagaaaaactatgctaggaaattacagagccaatccattgagcagtaactctgggaatatctttcaggtaccttgaaaaataggagcactattaagaagctccttctaaagaactgttttggagtgttgaagaattgtccacacttggactttgatcactgaaataatttctacgtccttgcttgtttttctcatctagtcttgaatgacattccttttccttgctccttgtacatacttgtgtctaaagggtaaacgtaaataaacatagccctcttcaaaaagaacttcaaaaataatttgacaggtcttagagaagtcaaatgtgtttagctccttaggacaatgacttttatgtcaaatcctttttggtcaatgatactcttttaaaaatgtattgtgaaatgtatgtgaacaagaccatattagttagggtaaagttaaactgttctaacaaaaagactccgaaatagactggcttattgaatatcatgtttatttaccactctgctaacaggaagcattctgcttgtggaggatttgttccactctgtcattcaaggagccaggaatctaccatggtgtcaatgccttcccgaaggtattggtctcatttacttacccgccctggtgctggcaaaagatgtgtatatggcaagcacaccctctgtctaatggtccctctactcaaagtagcattcatcacttccactcaccttccatttaagagaaattggtcttgtgaccaatgtctgcaaaggaggttggaaaatttagtctagcttggggtctacacatctgactacaattctattacatggaaagaagggaatatcacattttgatggacttccagatatttaccacccaaagagaaaagaaaaacaaattaaatcaacaggttgctcgtagataaattagtttaggggcagtgtcagccacccgtaatgggtacttgctttgcaagaatatttggtaattttgatagcatatactttattaaaatgtctttataatgctgagtgcttacaaatttgaaagtatgaaatttttaaggcataaggacagtgatctatctttagttgtcagacactatatttagatatttagacctcacctcaattgtttacattttttggtaccaaaactccttgcaaaattttcagatacatcagtggaaactaaaatcaatacattgagaatgaatacataattgcattatttattacattctaattctggcccatttccatagaaatccttggaggcatcaatcgcaatttgtttctgcaacactctaaggctgtggggccacagtcatccataaacataccaggagtcctgagcagatatggatttacatcctgtgtacctaggaactctggggaaatgtgagtttagggcagagtctgatcatagttgagtggaaatattacagagaaagagagagaaaatgatcatatgaatatgaatctaaatctcctgggtagtcaaaggaaatctccttagaatctttagagctgaagataatagttcatacctgtttcccatttcagccgtgaacaacagggagagtttcctacaagtgactgcaaattgaactgaaattaacaaaatcgacatgaaattgcctcactttgtactttattgacctgacttcatttctaaatgttttaaatgaatccagttttaccaaaatgttcctagatcttcttaagcaattgcgtttttggtaaaatgcactttccctttacttgagatttccattctggtaattgtgacttagcttatgaaactgggctctaagttctgtcactgttatattccagcacctagctcagagcaggatgcagagtaaatcttaataaatatctgtttcatggctaaaaaatacataagcagctctccaatgtaaggaggctactggcctgttctgtccactctagagatcatactctggattcaataattactgagtctatgacaccctggtttctatttttttacttactctaaggaatgatttcattcagattttaagacgataacaggagagtcagttaataaaaatagagcctaatcttttagatgtggttaatttttaaagcggttttattaaactgtaattcacagagttgcacaacaaccatcataatctatgttcatcatgcccaaaagaaatcccacattagctgtcactccgtcccctctctctcaaccttgggcaactgctaatctacacttgatctctatagatttgcctgttttgggtatttcatgtaaatggaatcataaactatgtgatcttttgtgactactttccttcatgtagcaaaatatattcaaagttcgtccatgtcatagcatctgtaattaatctctttttattagtgttcctttgtatcaatgttccacattttgtctgttcattcaggatatgtgcactgtttctactttttggctgttgtgaacgatgtttagatgcagctcatttaagcataattacatcgctaaatatacgcactataaatgtaaaacagtggtgttctgtagttaatttttagtcttccttgctgtttccattctttggtcctctagtttctctcaggcctctccaaagctacttttgcttgatggctctggtgtcctgctggcctatgcagtgatgtaggtttcttgaaacatggtctgtatctctgtgtgtagtcagtctgtacacatcgcctcagagttctcttagagtaccaaagaacatcgtggaaggagagcatgtatcaaagtggctttgggcatggatttcaggctccgatagatctaggttcaaattctgagtctcttattagctgtgtggcctcatgcaaattgcttaatcttcctaggccttaataacctcaattctaaaatgaggttaataatggtataattattgaggttttttagtatgaggttaataatgtaaaatgaggttaataatgaggttcatataggtaataatgcctatatcatggggttgttgcaaagattaattggataatgcattaaaatgcttatcatagtgtcatatataaacacaaacatttaacaattatttttaatagtaacattattcttataactactgctgtcattattgccctgccactagattctgagttcttttagggcagggactttgattattttgttcactgctatcgcttagattctagaactctgtctatactattgaacaaatacttcactatttgaagaaggctttacttttgttctggatgataccagtcagtggtcccttatcatgagagccaccttgctttctgtttgcttgaatttgctgcttttatgaaatccaggtgtctcatctcagccacctctgagtcctgtggtatagcctgtgagttcagctgtctggaaatgaagtctgtttgtaacattatcataccacactttatacataaccactgtagccaattgtttaaaaaatagtcaacttgcttaagcacttccaagctccctaaaatctaactaagtcctaagaataaaaaggaaacattttgttttgactgtaaataaatacaagctttccataagagagagagagagagtaattatagttatttgtggtctgaaatgtgaagttatgtgttgtaagacagcagattcttacggacaaaaccaaatcatgtttctgtacatagattttaaatgcttccttccaacccaggggacccaggggagtagataacagttgccacttagcttacagagggaaaaagtccaatgcttgcgtttcgttggcccaaaatacccggaaagcttgcacagtttttcatttctaagatcataggctcttagaactgaaaggcattttggaaatcatacttgtcctagatccttattttcctggctgggaaaaatgagacccagagttgctgagtgacttggctagcaacatccaactagttcatatcagaaccaagaccaatgtgttgtccagccaatagggtgaaatagcaaggggagaggtctgggaatcagacaatcatgaaccccaggatggtccacttgctgacctcttctttgaactgtagttccaagcttcctcatatgttagatgggaacagcattaatatacaccttctgctattagaagaaaagaaaggatttgaattgaggcttttccagaactgagtagagtgccaaagatttgtgtcaataaatgtcatgatggcaatactttctctaggtccccattctctcctctgtgtcttcttctacccaaactgctgcttctagccaaatcctgtttatatggactaccccaccttcagccattgggttcatcatcagtgacttctgaagactgactgaatatagaaaatacctgcacacccatccttctatgcatcatatcattgtttcttcctctttatcatgaaagatcctttatagttaaaggtgatgcatctgtatcctcagggtaccaaggcataggcagcctgtgcaagggaggatttttgttcttgttgaaataaaacattgtattctaaagcagaggcgttttgcaacctcattcttaaaacaaaatgcttaacattactcactagttaagtaattttatggccctcccccaataaatcttgtacatgaaccctcaggaaggtgcacatcccgtggtttatggtgcctctggcacactgccaacaccccagtttgaaaagccaggcattcaaccaaacttgcgaacgccagcccttgcatataattacaggaacctgtgaaagtgatcaccggcagctcaggggctccaagcttccgcaagttctgaatcccttagcaagccggaaagatctgctggcgctgccgtagggaaaggttagcatcctaaattatggcctttcaattttttttcaactttgcaaatattttatcttctcatccttagtgaaaaagatagaagtgcacagttgctgttttcccatgttgtttatagaaggaaaggaggtctcaacagctttttccatccttcataaaacaatgaaaatgtgcctcgtggccaggataaaacagtgatatgcatcgagtgatccaggaaatgtaaaaatacttgacttgaaagactttttaaagatacctctgcacatgttaaaggcagtggcagtactgggacctaagagtgtgcgtgtgtgtgtgtgtgtgtgtgtgtgtgtgtgtgtgtctgtgtgttgtataggaagtatcccagtgcagttcttctccctacaggcctcactcccaactacctgtccagcctaggaagaggtaaaaaataggaattgtggtgagcatgggaaggtggtgaaggagacaagcaacaagagacagaaatgccaagaagttaaagcaagctggctgcaagctatggcagggcaacaattcctgggaaggcagagcctggctagcagaggagctggggcctgcagattggtcggtgcctttgctttcctgctgtttccacttcgtgttctttgcctcctcttcacactaccaactccttccacttcacacgttctatctcaagtgaggcagtgcccatctcaaaggggccacagtgttagagctgctaaaagcaactaggtaagtgggaagatggggttcccttattttcctaccaggctctccagccccagggctgccatggccacttctccagctcccatctcacttcctaccctaggcctgccataatctccacccagctttctttccaggagtgaagtccagtgtccaatcgagttgccatgctggacaaactgaccttgaccttttctatcccagtgtattatcttgtctctagcagtagccatccttaggaaaccccaggaaatgctatgtttgcttaggacactggaaacatggggtaaaatcaatgaagctgttttgtgttctgccgcagggtgaagcaggaaagaaatctaatgggggagtgactcatggtaagagatagtggccctgtctctcaggctattagaaggtaccaaagaggtgaatacagactggttcaggcctgtgtaaagcccaagtatttatccttgtgagaggccatgacatttttcctccagttccccaccctagaacctacactcttctaatccccatcccatctctgcctcccctttccttggaatacaatgttacaggctatggaattcaccattagtaatgtcaagttgtggaacttccattccttctgcttggaaggtagaaggcaggagagttccctaggagtggagaggagatgctagaagcccaatccaaaattccaagaacatttttcttaggatgaagactaccagcatggctttcaagccctagagtggtcttaccttgtgcctgactctctttcagtctgtcctagcaggcattttctctgctgtttgcatcctcagcctgcagaactcttactgcccatcttcagctggttaatggtggttaacaagcaaggcccctggagggatgcttgccctggcgtccctgagcagatcaaacctccttattaccagctctcatggtgttacatggctgtccttcatagcccttaatacaatcaaagctttatatttattggggtgattattttatcaatgtcagtgtctggttttcctcaccgttatgtcccctgctcccagcacagtgtttgacaaatggtagagagtcagtaaaatcttgttaaataaatgcatacatgttcctgtaaaaaaagaagcactatggtctatcttcattataaattaagtcacttttgggcttgtcctgacaacaaaattataatgcacagtattatcttgtgagaatatgaattataagtttcaaataatcaagtgggaacaaacagttttgaatatgaacaacatgtaagttagagttcttatatttaattctagggatatgtttatcttcttttcttataggacatacaaccaaataagtgttttgtcttactataaagatccaggattttgatgtttgcattgattatccttacagtcatcctaggctaacagttctgcaaatggtcatcttttctcttagggaccatccctaagaccttgaataactcagagcagataatcaaactatctaatgatcactgagatcatttatgcatcaggatttatcaataaaaaataaaccctttgaggtactaattgattttttattcccatccccaaaatggcagctcattagtgtctagtcaccagaaaactggggaccatgtggcatccctgtcccctcaccgtctaatatggcacctgttccatggaacatactgaataaatactcatggcattgaaatgaatcacacctatccctcactgagccttggctaataattgatcagagagttcatgatcaccacccatccttgagagggctcctattaaaaacagcagcaacaacaacatgtgactagagcatctgaacgcttatgtagcactgacgttaacaaggataacaggagcttgaggggcattttttaaaaggagtgcttttaatcattaaagtgagatacgcacatgctaaaaaacagtaaagcaatataaaaagtcatcaaatggtaaaaatctcttcccaattaaaaatgccagtatccctcttaagaggcagccactgttgagtttcttatgcattttccaaaaaaataatattcacttcatatataagcctataaatataaccaaattttcagtctttttattttcatggtttccaacttagaaaggccttctatttcaagattatttttaaaaattaacccaggtttcttctagtgatctagtaacattttaaacatgcacagaggctggacatggtgtctcatgcccgtaatcccagcactttgggaggccaaggtgggcggatcacctgagatcaggagtttgagaccagcctgaccaacgtagtgaaaacccgtctctactaaaaatacaaaaattagctgggcatggtggcatatgcctatagtctcagctactcaggaggctgaggcaggagaattgcttgaacctgggaggcagaggtttcagtgagagcaaagattgcgccactgcactccaacctgggtgacagagtgagactccgtctcaaaaaataaataaacatataaaaataaaataaacacacacaacagatattaagccattgatttatgtatatatgcatatatacacacaccatacaggtatacatagatatcacacatatatacctgtatgtctatacaagcatacatatacattatatacactgtatattatatatagtatgtttacttgtctgtgtgtgtacacatacatatagtgaagtatatacctaaactactaaaggagaaattttatatatattacaaaaagttataaatgcatgctcttacctatgtatattggtttgaagaaaaatataaaatacttaaaaaagattttaggagtatacataactttaaagaaacatataagtactgcccatttctttcccaaatgatacctatttttataaatttctttagactcaataattataaggtaattttttatgattaccttttatttatagagatatatattatagttttaaatgcttatatgtacacacgtattatatacaataaaaaatgtattacctattttgtgtgtgtatttttgtgtatgaatgtgagagaatgtggtgtgtgtgtttctatatgtcagttttaatatagtctccaggcagattttaggactttatgactttctttttaaaccttctgtctatggaataattgtgttcattgcttcatctatttcttgcaaaatagtgacaatgagctttctcccactgactaaaaccagacctgttccacccattcccaccccacaaatgagcaagtcatgtaacatgagaataaattaatagtgaagccctttgacagttgtacctcaggtgcttctgatgtgcaatgacatctctcagaattaaacctaccattgtcagtttgtcaacgattttctacaagtacaaaatggaattgcgtccatctcactcagatttggaagcaagtctgattatgggacatactgggcttgacaagctaaagacagatacagacattttctcatttatgaatctattcctttgggacattgttaaaattttaaaaaggtcgtatcttctaggaggggataagtaacataagttattttgcaatagctatcaatgtgaaattttgtattgtcttttggaagtcagaggaagaaagatgggctgcctcggtgcattttccatttgcccgtgattagcatgttctgaacatctcagtgggagtcagaggtatgcttctctttgggttttttcagtgtgaaggatggaaggaactctttcacacctttcatttgcactgttaagacttacatcagaagtacaaagcattttaaactgacagaataaaaagcaaacttcagagcaactttcctgcctatggtgctttccaaggatctaagacacatgagcaaatctcctgaagggtggtaaataaaaaaaaaaaaaaaaaaaaaaaaaagagtcacctttggccctttcttcatctttgaaatacactcgagaatgggctctctccctctgaggctaaatccagtgtgccctggagctgtcagacctgcagaaaggccctttttgccaagcagtctgagagaagactagcggtaattggcaatccagttctccatttccattgtacagccatccctgacaaattaatcacaatcaaatgttggctgcagcaaggggcaccctacacagcaggaaagaaaaatgaggcctcacgctgatctgacagccgaatctttcaactcaccccattagactgaacaaggggacgctgtggtttgcctgtcactaccactacccataaacaaactgctcgctctgcatctcaggacttggtggatccagtaaggccttccttggggcccaccaggtatctgaacaatcagtgcttcagagaaaggggaagggcctcatcctggtgagaaagaggcgctagatagtggcatagtggcataggagactggtgaggacaccgtggcccaacagaatcctgaagtgatgaatctcaggtttgacagtgggttgaggtctgctgcaggctgtaacggagtgtctgtctgtgcgcttactgctcacctgttgtctatcagccatcagtcaggtagtgagaaatccagccctttccatccactgtttagagttcacttatcgggcaagcttctttgttcaacataaaaccaagaatctgaaaataccttaaaatgttatttatatacttgcccagtctctgtagtaaagtttataagccttagtcacagaagagagtctgaggccctcactcttattttaggcataattttaacaagtgtgtcacagcctatagcaaattagaagatggcaggaagatcctgagaggtagatgctgacagtaaacagtgggataatactgaaaggtgacccaaaaaaagatagataagtttgtttccctgcctgccagtagaatataagagaaaatcatattttgaaacgcttggtcttttttaaaagacaaatgcttactctttgtaaaagctgtgtaatgaaatgtccccgtgatgttagatctgaagtggaagagtctctcttctctcccatctcctctgtaatattcaagatgtggtatataactgaatcacatcaagcaagaataataacgctgcctctgttctgatcaagtttacccttactccttataactgtgggcagtggcattcacggctctgccatctggctctcacaaaactcagggccaggggcttgtgggtaggtggtggaatgttctaattcctggagaagatattattattcagactgtataactgaatagcatcagtttctctaagtttttccatttcacctctcccagacaactgagtataaagaagtataattaaaatgttggctttcataaatgttaaagccacatttaaaacatttctcatctctaatactaactcagaaaactacttttctccctatatatttaggactagagattttgtcaataaaaataatggagaggatttgaggtccaaattaaagcaatgtatttcccagaactaaactgagtgtgtcagtggcttgtccaaagtcttgtagaagccagaccatgaacacagcatcaggacctgctgtttagtctttattcagaggcacataatttggtgttcttctgatgactggtttgtttttgtgggaataaaaagaatacagctgaagggatgtacctgaattgctgttttcccctttctctctctctctccctgagaaagatacataataactttctaaacctgctccagcagtctaaagattccagtgctcattggatcatggatttctcattttaacctttctctttctccctccctccccctccaacctcctattcagatgtgatcttaccagaaaatgcaattaatttaatcattcctaacattccattattttgatttgtttttaaaattatgtttacatcatgatccagttcaggttaaaacgcttgtacactgactgaattgacgcctatctttaagttaacaacattagttactatgtcctggaaacctataattgtgcctgaaatcttatgtgttatttgtaattctcacaacaatcttgatagatcagtatcattttccttattgtacaaatgagaaatcgaagaccctgagaggtgacataagtagcttaggaaggggctgaggtgggacaaggacaccacctgacttcagaggtgtctgaaaacagtccttctctgggataaagaataccgcccagagaaacattctcctgtcctaaaaagcaccatgcatgttcaccaaagcctacccagcaagtgtctggtctgaagaattctccttttctagggtctatgccagtgcttctagttatctcatggcgagagaagcttgtagcccccagagtgggaggtctctaggcagctgtgagatttgtgctggagtgtggatattagacccaaagccatgggctttttaacattggcctgtgtctcccacgcaatccgagctttatgcaccagatcgttactctgctgtgaaaatgaatattgggtttatggagaaagctaaacggttgggaaggtgtgtccctagccaattgtcaatagaggctgtgagcttcagaggaggcaattgtaataggttttcagttgacacacagttatgaccaaagcctttgaatcatttttgtgtgctttaactattgtgtgtttgttcagctgtatctttaataagaacagagcattattagcagtttttaaatcattctttgctgtaggttataagcatcttgctgcggtattcttttcaaattattggaatctctctttccctgccttacatcctgccctaacactgccttcccctctcatgttcccctaacaaatgctatatccctctcatttgacatattcaaacacacacacacacacacacacacacacacacacacacacacacacacccttattatacaacttagtttccggactgcaacagttgtctagatgtttctgagttaggaaacttgttgaatcgatatgcaggtcttctctctgtttaggtctcatttacccatcacacatatatttatcaaatatattcttaaggtttccttctccaatttcatgagagacagcctaacattccaggccaagtttccagcagtcacgctggctctcttcataaatctgtaaaataaaaatgagctttctcctttgtgaaatctcttttttataagcttaatagagacccagacaagcctgagggatagctctgttgacctcatcaagtttcttgcagcaggatgtctctgcgaaagtgggcttttaaccatttcgcatactttgaactgtggagctgacctagctgtggagaggaattgattaattagcagtgatggtggatacttattaagcaccacgttgtgccttttgccttgtgctgtgttagatgtttggtgtatattaacccctttactgtcgaaggccatctgtgtgataaacatttactctcattgatgaggaaagctggcttatggtcacacagagaccacaagtaccagaatagtggttggaccaaggcatcccaacttcaggtttcacccacgtagccaacagcgagaattacatcctaccaatgtttagagactttcttcctgtgcatcttcagagacactgggcgtgcaggcagtagagaagtatttcacctgtcaccaatgggcccatttaacagaaaaacagcagaacactcagcattcctttttaaccagctatgtcagccatgatttagataatgagtgtgcatattggtcctacctctgtgtcatctgatttaatggagattccagttagtggcagcttatccggttactttagagactgattaatgagttgtcactgttttattggatatcggtcatcagaggcaggaatacaagtgtctctagcatctgagcaacccagaacattcaacaagtaataaatgaaaacgtcagggccctttagatgtgtgatttatgtacatacccttggggtactacacttactataaaacctacaatgcaatccttatccaaaattctgatggttttaatgtttaaatattctgcttgtgaaatatcatatggctttgagcaaataactgtcaggcctgtcgaaatctttttgtaatgggaagactgtgaaattatagttgtgaaatttgatgattttgaagaagaattaattactgaagtttttacagcagattcactttcattacccatttttctttctattgtaacgtctgtgctcggttttcctacatggattacaaccttctagatgctgactgacctctcatttcagctcatttttttaagatgggaattgattgacattttcaccagtcacgctggctctcttcataaatctgtaaaataaaaatgagctttctcctttgtgaaatctcttttttataagcttaatagagacccagacaagcctgagggatagctctgttgacctcatcaagtttcttgcagcaggatgtctccgcgaaagtgggcttttaaccatttccttttaaggaactctgtgtgttaatgataattgtggtatcttgacagtaattgctgggacaactggaaacctaaaggcaaatactggtagtcacagaactgtttgagtgcctgaaagagaaaagaatctctttgaactacctgatccaactctcccgacatcatccatgccccagcctctagaatgactgactcttcctaaaacacatcctttgcttcagttcctctgggcctttgcatacacagttccttcccctgggagaatctttctgcagatgctatctcttccacgcaagcagtttggagttctcttctgctgatcatcacacccattaatgactcttccttgtagtccctttgctgtttgctatttggatagacaagagtgactgccttcactgcattcaggcacaactatttatgattaggaatcaaaccgtgcacctgcacacaagctccctgaaggcaagtagatagtctttgcacctggtaaataaaattaagtgcttctggtgtgaactgagtcttcaggaaaggctattaattcttactgccaaattcagctagctttcatggaacctagaagcagctgccggggaagttgtgactttggcttctctttccctcattttccctagagcagtagttttcaatctcagcttccctttggaatcacctggagagcttaagaaataccaatgcctgggtcttacccctcaaaattctgaggtacagtggaatggttccttgtcgtgacctagacataggatttgtattgtctcccggcatattctaatgtacagccagggctgcgatcttctgagctggtgaacgtgaagtttggctgtcccttcatgggctttatagttttatctgcaggcctcactttttatgggcagttgacctcacctcacttcattttgtgtgatcttggccagacaggctagcacctgcaaagactgaggtatgaaaagggaatgctattcatttttctttcctttcttcttttttttttttttttttttaaaaaaaaagcatttgacttttgaatatcccttgagctggatgtatgaattaactaaaattattatggttgtcttctatttactgtatatattctgaaattctagtgctcaaattgtttcttctgttaacttttgacagtattagaagatttagaatttgataaggatttcctgccttgactattctgtatcttagatgtttctattttgaggagctaaaatggtataatgatagatctggaagttataaaaccttttgctgttcaaattgaccgtaccaaattgaccatcatctccttgttctttctgagagttagatgcataatcaggcataatctcataatgttaccaatttatttcatgtgattgggtccaagagttacagagtaactgaaatatcccaggtggaaatataaggcaactggatttgcctgcccagagaatgaggagcctcattcacttgttggaaatgcagttttatctgagctttactccagtaccgtccatgatgactgcaagccagaatataacttgactcttttcatgtcgttggcagaatttgttaccaaattcctctgcctttagttgtataaatcatcccctttagttacttccctgttttatggctaatgctctgagttatttacccatttgaggacataatgctctagttgaagcttaaataaatcttgagtccctaggagatgcctggtgtcctataatgattcaatcttttagagttgcttagactgggacttgcatcttatctcttgttctaatgatttcatctccgtgaactgtggtttcccttcttccataaaatggagataacataatataacctaacagggttgttctttctgcaccttaaatgaaaaaaaaaaaaagaaaaaagaaaaacaagtctaagtacctagggccgcatctgattcataaggaacccttccatagtacatcgtaggtattttttagttctgtttttctaaactcaatttccagttacatttttccaattatttcccccagtaaaaggaactttgggctataaatatgaattatgctatataatgcttggtttcaaactgttctgagcatttccaaagatgttttggataataaagcatgcatgtgttttcatataccattgccttgcagatcaaggatgactattccattcacacaaatcacataggaaccaactcataaaaaggaaatggactccacctttttctccataggaagttccctataatagtgagatcacagcctcatttttatggtcaaactcaggacgatatttggattccccagggaagttaactttgctttcatgaagctgctgaaatataatccaagagtcaccatcagtgataaaatcatgggcttagaattgaaaagctggagttaacactccaggtatttaacagccagttaaataccaacattcttattgacaaatttagcactgaatcagagaacagccctaagcttataaagattataagattctttgggacagataaaggcaatgaactgtttttttgtttttttgttttttttttttaaaaaaaaaaaagattgtgccatttattcagtaggtgtccactcagtactacctgagattgtcattggtgatattcatttagttctttcaaagttccatgggtatttccagagtttctgcctcatcgtatacaatggctcttctggacctggcagatttgggccaggatgcctggaggaggacagcattgggcaaatgcagagaagtaccccttcacctgcacctggcctttataattttaacccctcagtggtgcgtactgtgtgagcagtggagagtccttaggctttcagcagacgttcaaggtctgcttggcattttgaaggacaagtgaatgttgcagttgtgagcctgatgcagacatttcagggagttcctagagctgccagtgtctgtttgattgaaaggatagaagttgaaatattatcagaaggccacttggaggtctgaggaaatcagagtggaaacatttcttgagggcataatatctcaaaaatgttactaatatttaaagctgggaaatttgcctttttaaaaatttttccatgataaaaatttgtagagagagaataaaatctcttttagctgcagcctcttcttcattactatctatgcattatcgctgctattcgcccaagtctctcctatctcctgccccctccccgctctcccctttagagtactgaagtattatggatgctcatttggtgttaggatgtaattatccaaggtgaagaaatttagcagaagctgtgtgctgcctatttaacatctgaaacagcttcttaatacctgccatattaatggcagcctttttccccccactatccttgtatagaagcttccttgatctttccaggaagctaaatgctctccatcctgatcattaactaataattatccaagaaggtttcagtcttgattttttgaactgactaaagaattacggctgcctgctaagtttctaagagcgatggaagaagctgggcgaggggaatgggaagtgaagtatgaagttagtaggggtcttctgagttcaaaaggcttcttgctccttttctagacagttttcctctcccgggagcctatgggaacagtaagaactcagattatgattaggatacaaagacagtccttgtggtagatatttgtttccatttctcagcatttgtccttgttttttttttctgttttcacattattgcaccaaattttcttttgggggccacccttctccaccctcagtccaagtggttcttatgagtttctatctctagccacaaagatgtagtttgtgacccaaaactggccatagtaacagatccaggaacacgcctatgacagaaatctggtcaacaggttgattctacacttctagctacagagattgtttcagagatgggcacattgattcccctagagtgatgttttgggtaactactggaaaaagacacgactattgtttctgctgtaattgaacccaggagaacgaaggtttgtagttgttttcagccactctactcccgtttgaacccaagagtgatgtcaacatggataaaacaagaccccagaaacttttcataagaaggaggtgcaggtaacacatcccttttcagtgtttctattatttcctgtttacttcctgtttctgccaggaccaattggcaacatccttcaccctggcagtggcagttggttccagattccaccctccaacccctgtagcacctgagaaccaggcttgagtttctcctcaaaaatattagcaccagcaggcagcacggtttccacagaggtcttggtcccagctccttggggacctctttcaagttctagagcctccaatgccaactgaacagtgctccttcctcagtggtctgggtttctactgtgtggggacactcctctaggttgcaatgatcaaaacttcttccctttgatccaccagcccttagaatggtagctgcttcctgctttgactgcctgttagctcaaggctccccttatgccttttcagcccttcaaaacctatgtaaacaattccttctattacattttcttttaaaataactgtggtggtttctgtttgcctttcttgacctgactgacacagccctgaaaagaaggaactaccaattctatcaaattcccatggcctcatagacatttgtgtatgattggtgatcttttctatgaaatcaactgttttcagaatgagctctgcacaccctagagaaaacctaagtgtgatggagaagtgagggtagatgtggagaagatgaatgagtccacttttcttcattataaatagcttccctttaattatctctctctctccatatatatatatatatatatatatatatatttttttttaatagatggggtcttgctgtgttgccctggctggattgcagtgagctatgagcatgaccatagttcactgcaatcttgaactcttgggctcaagtgagtctcctgcctcagccagcagagttgctgggactataggcacatgccaccatgcctggctctgtattgtatgttttggtaagatttcatgttaaaagtattccaaggatgttctctttggatatttatttattttaaaaaagtattcatttactttacgagaatgtgttaaagtaacattgtctagctatttgattgaagttgtctctttctactcctgccagaaataaattctccctacggtatgtgtcaataaactatgtttatcttagtcttaacacgttctgtttaatattagggttatatgttacatttttcttccctacttgactgtcctctccaggaaggcaagaaactggtctgtatcattaataagcacttaacaaggacataaaagtccttagaatgagtctttacatacaagctggagtacagtggacaagttagttaactctcttttagcctattggtttattttaatacaaggataataatacctactttatacaaattgtatgatcatttgaaacttaaatgaaatattaattattcttattattagttgttctgcaaaacttctcattgtcgacattccagcacttccactcacttggtcctcagaaaatatctattgaataaaatgaactcttgcagttactttgccacatgacaagccacccagaaacttggtggcttaaaatagcaaactgaggattcttcccgaattgctatacattttgtttatgcattcaaggtgtaaatggagccttttctatgtaaaaacaaccaagctgtagacttctttgtgtaaatttactgtgtaaaaataagattttttttttctttactattaggtcaactagcctcatttacatcttttattaaacatactcacaactggtggtatttttttcctttatgaacaaagcgaaattatagattccacccaaatcatgttggaatcctgctaggtgaaaattatatgtctgtaagagctacgtggaatctagtttccagatggaattcccttcttgccaattttgggaatattctacaaagtttccccttagaaaccatttacatgaagtgaaaaatttactctaggaaaatgattggagagaatgcttgtgaaatgtgaaggcatgacttgcatatggacagtatacacattcatagatattttacccgtgccgttgagatagctagtaataatgtgtgttctcattgtgtttgctcttgtctgtagagaccaccagaaactgatttagcctgaggaatatatttcaaactgaaatttttattgtaaagtaattgcaaataacgtgtaattaaaagtgatgagaaccccttacatttgtatagcatgtttactttccaaagcacgtcatgacctcttgcttttataattctaaaaaattcttgaaagataggaaaggcaagttctattaatattatatttggacaaagaggcaaatagatattacagctgagtattcttaaatatgcaagtgatattttgttttgttgacaccttggtttgttgatttgaaagcccagtgcttttgatttagcttcaggtttggtaaaaaaggagaacagtatttactgaatgaataaacttcccctttgtaacatatttgtgtcacaactctgcaattatacaaagagactgatgtctgccttgtgggaactataattgccacttggacaagtttcatgtggttgacattaatagaccatgctgattatgactgacaaccaggggttcttaaacttatccagtaaaagggttttttcccctaatatcaaattcacaagccactattctatagtaataaaaaggcaactatgaatttggtaacgtttaaaaagttatttgcattttattaactacaactaatgtatacatttgtaaagtagtaacagatgtatgcatgaaacatgctattcatgataaaagctagtcttcatacacataggaattctcaaaactcttgaactaacccagtgttcccctgggagatcatggttaatgagttgggaagctttggcataactagagatagccattacactacattccatgtgtcaatgccaacaggaggaatgaccgcctgaagaggtgtgttgaaaaggattctgagagctagtttgggttcagagcaaagagtactgtcattaattagtgatgtttgccagaggaggaggaagtaatgggtgggaagagccaaacatttgccttacctgacttagactatgtggaccacttgactccagcaaaggataatggagatgaccactaatatctagatataacaaaggattaatctaagaagtcagttaaaatatacttttaggccaggtgtggtggctcacacctgtaatcccagcactttgggaggccaaggtgggtggatcacttgaggtcgggagttcaagaccagcctggccaacatggtgaaaccccgtctctactaaaaatgcaaaactagctgggtgtggtggtgcaggcctgtactcccagctacttgagaagctgaggcaggagaatcatgtgaacccgggaggcagaggttgcagtgagccaagattgtgccactgcactccagcctgggcaacagagcaagactccatctcaaaaaacaaacaaacaaaaaactttaaaaactactgtaaaatataaagcttattttaaaataagcacatttaaaaacaggttacatttactgaatattttattccaaacttcccctgctattaagcaccttgttcttgatcctacagcttgaggaaaacctctgtttttctctcaagacaaattgatgattgaagtatcctagtcccttctatgattttagccattcgatgaaggatctttgcacccatcagttgatactcactcatgttgcagccatctcacatagcttgtagtttttgtttgtttgtttttttccagaaacaaggtctcaccctgtcacccgagctggaatgtagtggcacaatcacgactcactgcaaccttgagctcctaagctcaagcaatccgcatgcgccaccatgcctggctaatttttaaattttttggtagagatggggttctccctgtgttgcccaggctagtcttgagctcctgggttcaaatgatcctcctgcttcagcctcccaacgtgttgggattacaggcatgagccaccatgcctgacccatctaactggctgttcttttcacgaaagacaagtcattccctgacaccatttactcagaaatgggagggagtggagatatggagaaaagtatctggtagatgactttgctctatctgtgcaatatcactgtttatagacatgcatttccctaataatttaagtcacttgccctatgaactagccaacctgcttcctcactggtttttgaaatatctttagagaaaaaatattccagtgatatgtttaatttatatgttaaccattcttggaatctcccagtcccttctaaaactcttttgccttagctttatcccactctgactgtattgaagataattaaacataatcacatcatctgacccttatgtacctgttcagatggtaattgtctttcagaactccatcttaagatagcaccttcttagccgtccctggaaattaattgctctgcctctagatcggctttgtttctatcttaattattgctctgcctgaaaagtctattttttgcttgggctttttgaggtgaggatacatgtcttagtcatccttgtatctccaatgcctcgaactgtgaatagctcctggtaaatgggcataaacactgggtaggactgacactcctctgaggcacttacctcccgtggagggagacctgatttgatttttttactctctttctaccctcagcatattccccagtaaaagctagcttgtacctttttctttacttgatatactctctccctatttttttggagattatatcactttttcaatactctatataggtagagtcataaataaagataactaaggtgaatgagatttgccacatttatatgtaggaatttctaaacaccttagaatgaagtgcctttataagaagaatgaggcctactttcatgggatatttaaagtataaatgctatttttttattttgtttttaaaaagatgtatctaccatgatacgtcataactttagaatagtttttgacttttaacatgaaaatgaaaaccagcatttagccactcaagccatgttcctgaaggggagccaggcaaggtggagagtgatgatggggtacagctctgtctgtgttaagagctttcaggtgtcctggcttcagcaaggttctggcccaggccgtgagacaaatgcttggcaatctcgggatggagtttgcagagcaggcagaattttctcctcataactttagaacagatgaatacacatttcctagattccttgaggggagcgccagctcagggctatccatagtccacaatcgggcagggtgttgggcttcaattcttctctaagcgtgtgaggcatgagaaaacggggcaaccctgcaggtcgggaggaaggggtagacatgtggctggggctccacaagagtgacggtcatttcatcaacatccaaagaccttgcatgaagatctaacctccatcactgtacccacaagtgctcccatgtgcccaccttacctttggtggcatctcttctttcgtaccctgtggaggaaggtgacttccatggccacacctcttataccatccatatttactgagcccatgcttaatgtatcagacagggtcctcagctccgtggacacagtgataagcaagtaacacatggctccagctgccatagagtttttaccctagtgaagggaaagtaaacaagtaagtgacatattttgttaaattctgtgtactgtaaaggaaatgaaacagagttatgtaatagagaaggacattatggagtgagggtggtggcagggggttactttaagtttgatcccagactttcttgatcagaaaaagtcgtggctgggcattctgcacaagtctttgcatctgtgtgcttattctttcattcatttgttcattcattcattctttcattcattccataaccataaatgctttgatctatttagctcattgcctggcattgttaacatatacagattaggcaggcttccaaattattttagccctgaggatatattaattcattcaattaaagtaattattcaagtactgtgttgacaatcccacctgcatacagccattggtatggggcaaaggctggtaaaagaacacaagatggtgtgattcatttagggtctgacaaagtgaacggtggcatttttatgaactggatcagaatctaacaaaatgcccggaattgttaagctcctcacactgtgatttggcctatgggcatgtcactggaaccagtggtctcatcattctttgctattccttccctctatttttctatatcataacaattccagtctgatttctctctaacatacttcctgtgaaaacctttaaaacaagggcttggagagatactaagaagaaaagagactgtattataattacaaagtgaattttatttatttaaactgattatgtgacagttgctactctgtaagcagccctccaaaattatttttgtcctctgaaagaaggtatttcatggctagagaagctcctaaagactctttaaggtttccctagagcctataaaaattgaaattttttgttttactcctgaggaggaacattccttagaggcccagcaagtctttatagatgcaatcataatttgcagctatttattgcaaatgcactgggtgctgaagttgggcattgcagcagatactgttgctgtcctgcccatggtcctcctgtctatgctcaccatgtccatacaacctgacatccactcaggagaaagtgtgttgctctatgaaggcattctctggctgctggaacctgctctgctgaagatcaggcaagtccagaatgccaaggaattgacatccactacatcccagctgtcctagatccacgagtgatgggattggtggataagtacccatctcctttgctcctcagacaagccaactccgaagtgtatgttctataccatttcccaaagtttcccagtgggctgtagccctagctgtccacagtggcaactgctttgtccttcaaatatatttgtttgcattatcctccaaataaattacttgtgctgaaatctctgcctgaaggtcagcttgtggaagagccaaactaagacaggtacattgcatacattatctcagttaatctttcctacctctccaaggcgaaacattgcactccccgttttacagatgagaaaactgggattcaggaggttatttttttctctctctctcattccaaatattctctgtctctcctctctctcttattccaaatctccttttctttatattttattgtgaagaaagtggccacagtatatggtctcttaggaaggtgcagccatgtggttaatgaattttgcagcagaagaataaatcaaatatttattgattcaaattggtgtaggcatggtaaaaaaatgtgaaaagtagaactttgtttattcattccacaaatgtttattttctgctaccaagtgccaggtactctgtttcttcctgagtgtatagtggcaagggagaggaggccctctgagaacagcagactgcattctaatttgtatgaagttcttactgaaatgaaagtttctgtgatgttaagattgtatgctactattcagtaaatgtctagaaagggcaatctgatttccgagcttctaccatgatgccagttaggtggctatatgtcagaaagcagagtccaggttctctctttttactttctggatagacctttactctttagatggcaaattttatgttttcctcccactagactataaatgtcttttgtagataatgaatatgtctgccgctgcattgaatttgaataaggactaatggccagtatcagaacataattaaatgcaggatccacatcaactaacaaaattagatgcaggacccctttcaaaagtacttgtgctgaggaagtactgaacatgtcaagaggatacttcctccatacttctattcaattaaaaaaaaaaagaaagagaaagaagctattgatttcagttagtgggaagaaattgggtttagccttgatggtgtcttaactacaaacgaaaccaatatcctggtgttgttcctgttccattcctcatgctctgatgatttcacagttgactagtgatttgcaccttgcttcaaattacttaggatgtattatggcattatctatgaaaacagtttgactcaagaaaaaaaacagcttgtagacaaagagagaagctcagtggctgtgcagtcacagagcagagagggcttaaaaggtttgtctggacatggaagcaccatctttgtgtcaataaggtgagtttgttccacacactttgccttttgtgtgcttcttttattttttctattatccgtcttctgctgttcttgcatcctttctcctcagatagatcttctgtatcaaaaggccatgctctaagccatcttcctttctcttcctcctccctgtcagcaatctcaatctccatgcaaagtatcactctgtcatgcaataagacattgtccccaccttgggaacatttttgctctcttagaagtattagaagatggaaaaatattcaagacccaaaggatgaacccataataatggaatttctgttcactttgcaagacctccaagaatggaaggggggatatttttgaaacacatttctatatagttcctatcattttcactgagatcactagaatatagaagatatttaggagctcatgtagtgaacactaaagccaattgctgacaaccactgattgacagctatgcattcaacactgacatacgttctgtgaggaattaagaaattaaaaagaagaaaaagtaatacatggtcctgatcctataagagattactgctggctaggaaatgtatataatatgcacaaaaacgattgatgttaaaatctgttgattggcatagtcagagatgagcaaaagaaaggaggtgggaaatggggatgatctgaaatgaaaggtagaattcatttgcaggaagaaaagaaggtagcacaggtgagggcatggaaactggaacaaacagggtacacatggaatactgggatgtggctgaactgaaagtccatgttggggagttgtgaaatacaagtgggtagtgagatcaatgtcaagctacggagggcctgggatccacaaagatgatggagcttatgggaagcagggccccagtgtgtccttaggcagggtcatgcctggcagttgggtacaaaaggggctggaagcagaggagggggagagaaatccaagtaaggagaccgactgagcaagaatccagtccacaagaaaggggccttgggcctgggcgatgccagtgggaatgtaaggagccatccaaagagcatgtccagaagacaacaggatacattcaagatggagaacgcatcagaagggattaagggggtttatgcaaatggccccagacacctcatcccaatattactcctagcagtaatgtaccaagcaccgactccataccaggccctattctaaaggttttctttttttaacttattttaccctcataatgatatgaggtctctttatttccactttctagaggcacaggtaagttaagcaatttgctctaggcctcaccaaaaaattagttgaaaacaacttagttgtcaacttgacaattctatagtttgcccatatttctcagaagtaagtctatttatctttctgtaccatttttattttattttattttatttttttgagacagagtcttgctctgtcacccagattggcgtataatggtgcaatctcagctcactgcaacctccgcctgccgggttcaagcaattctcctgcctcagtctcccaagtagctgagattacaggcatgtgccaccacacccagctaattttttgtatttttagtagagacggggtttcaccatgttagctaggatggtctcgatctcctgaccccatgatctgcctgcctatgcctcctaaagtgctgggattataggcatgagccactgcgcccagccctttctgtacaattttgaataaacttcccttcttctcagcctcttggatgtttgtttcaccttgtcactgtaaaactgaagcctggctttcccctgaggtaccatctcctcctaaccttcaacaggggttggagggggaaactactcctttgtatgtcatctccctgccacctgcggagtacggaggaagagccagggcatcccttgcacttccgggccactttcttgtcctgcagagataccaccaatcccatcttggcttgtgtccacaaccctcatgggctctccctttccaccctcactgcctccatctgtggtggtccagggctgtttctcagtggcaggacactggccaccttcttgcctattcttctctgccattgtttctggggatattacatcctgatgtagcagttcctgtattcttctgcctctatttcagccgccatcccagaccttgccttacctacagcttctgcatcactgtgattctgaacatagaactcctctctgccacctttgatctcttgtcctccctcacttccttctttgccttctctcagtccttggctttgctgatgctctgttccctggcatgcttcctggtctcccaactcatctctattcttgggcttataaaaagttttttccgcctccttcatccatcttggatcctatggttgattatatcaacaatggtcttgtatgtgcccctttctcctctttgttttttgtcctttcccttctttattagtcacttagttctcatccttggggaaatactgctactcatattttccaattctcttccaaaactatcaacatagggatgacaggccagctgtattttcccatcacacatgctctccttccacacttgaacttctgttgcttctcagctgggcccttaccacttatcagtactcctagggatcatctctaatcacttgcctactacatccttccctgcattcaatcccagtgttccctgctccactcaaggaatggcagttcaggaaagagtactcattataccacccattgtgcgaagcatttgatatgattgcatatattcaaacctcaacctggtgtaggtagtgttattctcatttttttcatatgataactctgggactgagacagtaacttacacagaactcaaaaaaaactttatgtttcatgtctgtttgattcccacacctgtgggttttcaggtcgtaataaagcctccactgctgacctgaccttctgccaagtttactctgtagattacttagtttctttcttaaatgagataaatgaacctgtaacatgggactttccagttccttcttcttttccaccacattttttttgtatcttcatccatttccttctccttcttttctgtctaaaagaaggaattatcccctaatcttccttacagtcagctcctctgcctttgttatggattccaactcttctacctctttctccagattgatgatctgtcagttatcctcctctttctgatcacttttcattcccccttccaaactaaatatttttctttcacagcaaacaaatctgtcctcttacttaaaaacaaacaagcaaaaaactacttttcttgactttaagatcctgaacaagcttatcttctacctttcctaaaactccttgaataaagagactacatttactgtttttaccatctccccgcaatgatcccaaatcattttcaatgtggcatcttcctctttcctgatcccaaaccatttccttaaagtatataccaacaaccacataggaacagagccaacttctgtattctgggtgctcatttttcttaagttttctgtagctttgagtgcttcaacactatctcttcttttttgaaaaaggctttctcttgacttttctatgttttcttggttcttttttcacctattggcccacatctttcccaggtgctctttcctagctaatcttcttcctttatttccattttgtctctctttactctttcctttaagtaatgtgtcttacttaactgcaggcttagaagactatacccttctctaactttgacttttcaagtgaattcagtttggacatctccttcatttgtttcactggcctcagatttactttgtctaatactaaatctatcatcttatttttctttcccttcctgttttttttctattaataacaccattattcaagccttaaatcccgttgctcataactatttctttcaccttgttcccacatgtaatttgttgtcaattattttccagccttttttctctccacatctgttgaatatttcccaccttttcccctcttgctatcatccaagtttattctatttcctatcatttcagtacttgttttattaactagtttcttaccttatgttccaatgttctttcccataactaaacttggtgcagtaaaatccatgccttatgcttttcgggccctgtacctatgctcacagtacctctacagaatcttgttttctatttcttatttaaatcccattattctagggagtttgccataaatacatttcttccaggaaatttttctggtcttctgttctctgctttttatccctaatctggtaagaatctttcttgcccctaaactcctaaaacatctttttctcatacttctagtttattgtcttaatcctaatagaaaacaatagcaagaatgaacttttgagcccctccacccaaattgactcatctttatcacttactagctgtgtggccttaaactagttatttcacatctctgagcttcatattactcatccaagtaactaaaataataaggcctggccttcaggtatattgggaagattagaaacaatatatggcatggtccttaacagtgtgtttggcccagaaccaccattcaatagatgttgagtgaaacactttctctaggtagagtatggggtgctgaagagtatgtacagactagggtatagagtaggcattcaaaaatatttgcacagtgaaagggctgggattataagaggcaaacatctaccatcaatcctctgtcagttttaaaatctgtccaccagatatcagagaagaataaaattagactgggtgaatgtctgacccatttatcatctatcagggagtaacttttgcctgaagacatccccccaggacaatagaaaccagcattctaacattgaatttcaactgtttgtagtgaggacagccatccctggtcccattttctgagctgagtattaaatttactgtttcctaagcttgaaggaattctacacttgcatgcattttaaaaaataatagctattggttgtgctacagtgactttgccaattcccttagtttccaactctgctaatatccatcctgctcttaacagcttcctgacttgtttcctttctctagtcccagtttgcttttctcttcacaagtgatatccacgtgggtttactaatcagatttgcatgtttttcaatagcacactcctcaaagtgtccgttttctatcagctaaaagaagcaaaattaagatcttttgttttccaacatagaagtgtgtctgcatgttccagagtgtggttttggagttcagactgcctagatttgaatcctggctcaagcccctgttagctctgtgagtctaggcaaactcatgccattgcggacctcagtttgtttctccataaaataggaacgagaattaattatgtctaatctgaaatagtatcattgggagaacctaaatgaaataaggcaattgaaaactcttaagatagtgcatatctcattgtaagagctcgatatacattagctgttaataacaacattttatcataaatcatttataactagcaacttcatggttgatttatgctttagctttccaaattgtatttctatttattcattctacgtttgtggatgtttatttttttgttggtttgtttttattatcccttaggatgaaatttcacttaatgagcgaggcttcatgttgtcccaactacccaccttgcacagcgttgacatctgagcggggatagtgtgagcaaaagataatggactagaaagcatctcacactctacagtggagatcttctctcaacctctaatttggtggttctcatctttctttgctttttcctgcttcagaatgcctaatgtactcccatcaatatcagtagctggctgattttcatgaagtacagattaaaaatgagcaatcggaaaactgactcagttccagggtgcctgccagcatacacagtaacttcatacaaatcagagaaaaaccaccctttgggaacagaggcaaccccataggtgcgtggcttgacagtttaattgcttttgtgcaagagaaagtagttcgttcttaggggtcagagtggggaggttgtcacccttgaacttgaacacagaccttggcagctgaccctggctggatgtcagccctatccactccttgacttagcacaacctgcatggaggccttgtcctgtaggcatatgtctccccacagcaggtaggaatcaccgttgtactcggaggcaggatcgcttccccctcgcccctacggtcagctctctgtacctgggggatccgcatctgcagattcaacagttgctgattgaaaatattcagaaaaaaaaaataaataacaatacagcaattaaaaaatagtgcaaataaagaatatagtatagcaactattaacatcacatttacattttattaggtattataagtaatctagggcctattttaaatgtttaagaggatgtgcataggttgtatgcaaatactattccattttttatcagagacttgagcatctgtggtttcagtgtctgtgggaggtcctggaaccaattcccttaggataccaaggtaggactgtatagtaacatctgctctgcacctcaccatcccaccactacaaggtacctctttgttgcttttcctggatgatgaatctgcaagaaagtttgaaagccatgctgatgaaagtttttctgctggcattaaagatgtggcaagctttctgttaggtaggaatgaaaggtggggacaaattcttttccttggcaactgcatgagagtatccaggaaaatcacattcagatgggagatcatttaatgcagcctatggagggtgaaaacagaactacatttgtcagcatttacagccatcattgtgttccctcagcaaacctccccatgctgcagcagccacaccccgcagtcatccatcatgctggctgaagagccctggccgcctgccacacacgtgccaaggggaagccccatgccccgttagtgtcagcatgtgctgtgacttgtaacaaagacaggaatgagtcctcgtccagatagccatgtaatcctcagagaagagtgcactgtggctgctgcaggcttgcccagaaagtctcctaccatctgaagggtaattctgatggcagaaaacattcaatcccactattcttagcctgactttctacttctagctttttcaggctcatcaaaccctctaaaatcatttgaggagaagaaaatgttcttcgttgcgttctataagggaaatatattgcaaaaaaaggaaccataggcgaacaaagaaagggaggagatggggccacccctattcttccattaaatttatgtcactcagccttgagagtcaagcaaaatgtttgaggccaaatacatcttttattaagttgtaatacaaagataagttatctagatttttgactgatttggcacttcacaatgttatactttttcgaatcccaaattctagcaactataagatgccactgtaattttgtatacctttagaatacattaaatatgatacaatgccttattaccccttaaaatttgtattttatatttatcaaaagagcacttttagattcactttagacacaggcttttgtgacatatcactctttcgcacacagaaaaggaaaatgaaagtgaaataaggagaatgaggtattccttagccttcataaagttggaatcttctgaatcactgtgctgctcaaagtcactgatagtcaagttttcttttggcataggatttgcctctgtgacatcagaaagtattgatgatgtggcctctcctgaaaacaaaacaaaacaaacatacaggcttggttttccaattttaaaactatattgttgttttgcccccccccggtaagtctgtcaactgagcacagtgtagtttttacatccttactttggtgtttccctgagctggtagagttgtatttgagacaaaataactattcattcaattggattgctgcattctacttcagtaacagagaagaaaaaccagcaagatatccctgtaaagcattgctatggttttggaatcctgcagataaaatggaatgtcttcaggtgtttgaaaatctgggtcatatgtctctacttgggaacttgaaaaatgtttgataaatgtgtttgatttcaagatgatggtgtttcttttggtttgtcagaaactggctctgatacatatttgtaagaaagaggaaaaatctcgaattactcattagactatcaacaatatgcccattctttgaagtctgactgaaatcctttcttctctatggcatcttctagatttccgcttggactgatctccactgtatctgaatttctatagtgtttttgctccccttttccattccttttctctatttttagtttttttttttttttttttgagacagggcctcactctgtcacccgtgccggactacagtggcgtaatcacagcaaactgcagccttgaatttctgggctcaagtgatcctcctgcctcagcctcccaagtagctgggactacaggcacgcaccaccatagcaggcaaacttcttttgtatacataggacatcactatattgcccaggttggccttgaactcctggcctcaagtgatccttctacacatattttacagctgtgaacctccatgcccagcctggtgtattattttttaaatcagacttttaaatcagatttttaatgaggttttttttcatcagattctgtctttggatacctgttatattatttttaaaatttgacgggtatgtgcgagttttaaaatttgagacaaaaagttggataaaagacatctgagaggcaatccctctcagttggacagggagaaaggagggagagaggaggggagtaaacccaatgaagggtacattaacaaatgggttattgctgtggcaacaagggttcatttttgttggagactgtggtagcctgaactatggcctcaaaaagaggtccgcgtcctagttcacagaacctatgaatatgtttccttgcatggcaaaagagactttacagatattgatgaagttcaggatattgggatgggaggattctggatgatccacatgggcccaatgtgatcgcaatggtccttatatgaggaaggcaggagggtcagagtcagagaagacaatgcaccgtaacagcagaagcagagggagggaaggagatgtgatagtggaatcagatgttgcagtgacgtgaggaaaaagccatgagccaaggaatgcatgtggcctctgaaagctggagaacacaagggcatggatttgctccagtgcctccagcaggaatgcaatcctgcccaagccatgatttttgctcagtaaaattcatttcagaatattggcctgcagaactgtaaggtaatgcatttgtgttgttctaagtcactgagtttataggggggttgttacagcagcagtaggaaaccaatagaagggttcatttttctgagaaaccatatggaccaggcttcatagctgtgccagtgaggttcgaggaggctgaggtatttgcccatcaattctcatcacttactggataaggattattcccagaggtggcagctttctatcggttctggcttgttcaagctgtgcaccctcctgtcccctctaggggccagagaaagtctttagaaagacaggtctatataaaataagatgccataggcttgtctacaacttgtctactgatgatgcatgtgacatgtgggatggatcaagggaagatgggtgcactggaattacctgccaccatgtgtaagtacgtgtatgcatggttgcgtgcatgactgtgtgtgtgtgtctgtgtgtgtgtgtgtgtgtgtttcttcctccccctttattaagtttttttgagcctagacgttctctcccattgaccagagccccaagcacagcacccaaatctgggaaaaacacttcttgaatgattgggtggcagaatgtgacagcctgtgaatgtcacagtaaataagggagttggctattttacagtgatgtcttctctaattcttaaattaagactgtgcagagaaggaagaattgctattccttggaaagattcaagagactctggagatgctatgtagtttggttgcaaggtggctgtcaatcacaaatgcaagttgtcaccaggcaaaatggccctgtcctgctgcgtgaccaatctgcaatctaagactggctcatcaaggttagcagataaatcaacacaaaaagagatgaacattgcaggcagtgctgatgtcaaacagagatttcatgcatctggcagaaaattgagcatattggtaaagcactaaagacttccttcatgaaagttctttgctccctggtcctgaaaggaaaattagattaatgctcacaaatccttcttgacatctgaaggatggccttctcttgacaaggctctagacaggaaaatgtgaggaacaccagcatggccttccctttgctaggtatctaatctaacctagctttctggaggcacttgttaagtactagattctcgctctctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtttttagccaggatggtctcgatctcctgacctcgtgatccgcccgcctcggcctcccaaagtgctgggattacaggcgtgagccaccgcgcccggcctagattctctctcttaacccttggcattattattatttttagcagttagcttcagcaagtgaagcactgctgattggagatgtgttttgtattctgactgtacttgcaagctctaccaagtacattagccttcaaaacatatttacgataaaggctgagtgcctgttccttaagagaaacctgcagaatggtctttatttttcacaccagctgcttcttcagatttgaacatgccagacaaatgtttgatgctcttgaatggtgtttgagtaaattaattgacacccaccgactgtcaaaatgtatgtattatgtatgtaaatataaaaacacctatatgcatgaatatgcagagatatgttttaagggtcattttgtggctaaaatatttgaaaataataatataagtaaagtatgatatgaaaattaatcttgtagaaaagtcagcagaacctaatggagattttagtgtagagaagaatgtgattaagccacagtagatccagaattttgctaatgatataaagtccttattgttaccagcctcaaggaaatccctgtctagtgcatattcatggagagtgaacgatgagcttgtgaaacatgtgagatgcaagtacagaaatgttggcccaactctattaaaaaccaatgtgtctcataattaagactctaaacacccccccttaaaactggccaaatgttggaatgagctggtgcccgccgcttcttaactcttcgctccagttttggggtctgtgcctcataaccatagtcacttttaaccaattctggttgcctccctgacagaacctgggattctgtgccatttctatgtgtgcccctattttaggaactaggtctaaagtaattaacagtttagaagtgataatctagtgaattagcttttgtgagggttgttttataatagcacaattcccttgttcactgcctactcctcctctgccccccttctccactgccttctcttccctgtcctgccctgtggatggctgcctgagttcttgctggctagcctctggttgggtttgtgtcataggggtgggaaggagtcaggttaccaggaggatgggacattgggagaaagtgattcgtgtatttcttacttgtctccaactccccatttcccaatccttcatttccccatgccactcccttttttccccacctggctatccttcccacccctgcgttgataccatctttttggaatgacgttgtccctccatgactgtggttagctgggaagcctgtacttcccagctcctgctctctcttgttgggctatggttacattattcccccacacttccacctctgagtgtctccatgtatcttgcctgtattttaaccatgcctgtgtcttcgtaagtggtccctttatcaaatttctgcatttaaaacatctatggaaatcctatttcctacctagaccctgatggttacactttactttctctaaccatagcattcttcaaacatgaaggaccacacgtatttaatatttaatcataccatgcttaagttgatacattggaatgccatagttctcatttcgctagcatgctattcaaaactttatttgtgagagaaacaaaaatagaagatgccatgtaagataacattatggtctgggtttatctgcacatgtcagtacatacctgcagagataggatctttgtctatggaagcaaaccaggaaggtatctgaatgccttggttcagtacccatcactctggaaatgactgaatgactgatgtgctttctaaacatgaggcagaggctggccaaatttcctttcaatctgggtgatgaaagctaagatgaggtaaatgttgtcacattgtgtttacattctactatatagtatatatggtatgtatatttctatgtatatgatatatatgtttacctacacatgtacacaatagagagagataatctcaaatatgaatggtactgcttaaacgcagtgttaactaaaagaactgcattacataaataaatattatggttataaaagaaaagaaaagccagagagcctactctcatgctttcgttgtatagctaaagtcatagaaaataaacattaaaaaaaaaaaactaatatttacaagacagcatacaaatgtctgtagtttaatttgggtataaacaagctacacaggtgctgaaggaattgcctgcagttaagagagaaggtgactatgcagaaataaattctaagacagggctggcttctgcccttatggaaaggtaaattagcccactgatacataatattagtggccaccaaaccattgtgacatcttgaatttcttctttttttttctttttctacggaagtctttacgggattgttagaacagcattggggggtttgtgaatcattatttattttggaggtatggagggaggtagcaaggaatgaattgtcatacccacacatgcctatccaggctcggatttcctcctttacttcaggccatacagatgattccactgtcctcttctctgttctcttgaaactgccactgcctgttccatcccaggctttctctcttaaacctggctgaagtaaaagccaagatttcgtttatttccttcttactcttaaagaacaaactcacagttactttaagttttcaaggttttttactaataagtatggtataataaagatttgacagataccacaccaaagaagatatacagatggcaagtaagcatgtgaaaaaatgcccgacatcatatgtcataaggtaaatacaaattaaaacaacagaaagatacccttacacacctattagaatggccaaaatccaaaacacggacaataccaattgtcgatgaggatgtgcagaaacagaaactctccttcattgctggtcttggcatagggattgtaaagcttaagaaaatacattgaagtccttgatctactgtctctaacccttcaaagggggtaaactcttttgtgcgaataccaaggtgtgagattgctgggtagtgtgataaaagtatattgagttttgtaagaaactgacaaactgtcttctaaagggctgtaacattttgtatccccaccggcaatgaatgagagtccctgttgttccacattcttaccagcattcggtattgtcagtgttttggatcttggccattctaatagatgtgtaatggtatctctttgttgttttaatttgcatttctcttatgacatatgatgttgagcatctttacatatgcctatttgccatctgtgtatcttctttggtggggtgtttgttgaagtcttttgccaatttttaattgggttgttcatttatttattagtgagttttaagagtttcttgtatatttaggataaaaatcctttatcaagtatgtcttttgcaaatattttcactctatctgtggcttgccttctcattctattgatgttgtctttcacagagcagatgttttttaattttaatgaaatttagcttatttttttcataaagcatgtatttggtgtcatatctaaaatgtcaccagtatatccaaagttgcctaggttttatcctgttatcccctaggagttttatagttccttgttttaaatttaggactattattaactttgaattattttttgtgaagtgtgtaaaatctgtgtcacgatccatttcttgcatgtgattgtccagttgttccagcccagtttgttgaaaagacttgcttcattgtagtgtctttgcttctttgttaaagattagttgactatatttacgagggtctatttatggactctgtattgttttccattgatctatttctccatccttttgccaataccacactgtcttgattactgaagctttatggtaagtcttgaagtcaggtaatatcagtcctctgactgttttccaatattgtgttggctattctggggcttttatctctccacataaactttagaatcagtttgtttatatccacaaaataacttgctggaatctgggttgggattgcattgaaaatatagattcttctttccaactgaaaagttgggaagaactgacatcttgacaatattgagtatttctatccatgcacatagactatctcttcatttatttagttctcctttgattttttttttatcagttttggagttgtcctcatatagatcttttacatattttgttagatttacacctaagtatttcattttcaggtagctaatatagacggtattttgtttttaatttcaaaatctactagtttattgttggtacataggagaatgtttgacttttgtatattaaccttctatcttgcaatcttgctataattgcttattttctccaggatttttgggtcaaacctggatttcctacatagacaatcatgtcatctatggataaagacaattttacttctttctttcccatcattatgccttttattttattttattttattttattttattttattttatttttcttgtcttgctgctttatctaggacctccattgtgatgctgttaagttcctggtctgataatttcaatattccttccatatctgattctgatgcttgatctgtctcttcaaacttttgcttttttcttttagtaagtcttgtaagtttttcttgacagccaaacataatgtactacgtagaagaaaaaaaagaacgacaataaataagcctttagtcatgtggtggttagatgtcaggggaggggaagtattatatagttatgtgattagatctcagtctcttggcaaccctgtacctctgaactgtgaacatctcaagtgtttcttaggtcctccacctcttttaggtggggcaagagggctagagtaaactggaattaggcatttcctttcttctatctggaaggctagagtgggctagagttgagtatttccctttccccaggttggttaggatctgatagaaccccaatagtttaggctcaggtgaaatattttctcttgaaggcaggccttattatgacacacagaatgctgtggcatgtttcaagatgtttcttcttttttcccttcccacttctggaagcatgaggggatttttctctaatattcattgtgagaacctggtccagctcctggaggtaaaaactcacaaaagcatgatagccctggatgaatggatccccttggagtttccatcattcagactggtccacatggagcctctagtaatccgtcagttagagtttaggcttttctactccagtactcgttcctgcggaggcttctgctaagggatttctgctcagataagttgtgattctctgtacccacctgtctgtctctccagttttggggacagcagtttgctctgtgacctcacttcttcgaaggatctaaagaaagttgttgctttcttttagttggtttagctgttcacgtgttggcacatgtgttaggacagagtgacatcttccaaactccttgcatgttgaaccgcctatatattgttattctcactatctaggatgtctaggaaagtaagaaaaagatcatgtgctggctctcattttgtcatcctcctgactcttcattttctttgagcctagggacaaaaatgaaggcctgttactttgtaagaagaaaaatgtcacatgttcataagtgaaatactgagcaaacatcgactcgatttttccctgaggaattgcttcaatctacacaaaagctccaccttcccaaagaggtccatcaaagtaaatctctaacatttgtgtttaaatggatagttatttctactatgagcacatcctgaacttcttttcctgccccagcaggttttcctggcacattacaactccaggctatcttgtatctgcttactacagctcaagcaggagaacagattgatttttgatgagaaatatgccttttctggggtttccttattctaccacaaacttggtccagagctcattgtttgtgaaatactgtcattcattattaagacgaacaatgatgcctgctgtgggaaatgtgcattttaaaatgcagttttcctcctttaaaattctgtggcttatttggtctcttcattctcctgtcattcgtcaaacacttgctataccccaagtgccttgctgtggttaagaggaatgagccaggttctgtctgtttgagggaaatggtacatgcatcacttccaattacatttctctaggcattttcaggagcagtaacttatgtatgggtaaaacttagaaatccaaaaccagccaaggggatgttttaggtagaatagtaaaagatcttgtatgcaattattgcatgaatcgcagtcgattactcaggtcattctaaattcattttagatgatttaaagaaacgtatccatattactaggatgtggtgaaatccactgtatagcaatttggggagtttaagaagtttcctttgggagttgatattatagacaatgacatgtattttataatttcttcagaggtttggctataaacaagacagttttgttgaaatctgttcatctactatcagttcctcttcctcaggaagagaatctgaaaaaaaaaggtaggtaatgtcaagttccaggggcagagaggggatagtgaatccatacttgatcttaaaaattgagcccacctatacttccagtcatcactctgtggcacattgaagagcatggagcccccacctggttttccaggcctactgtgcacaacagcattcctgtacctttaggctttcttatatctttcagctttctctccttactaagcaaataagatacatttagggaaggagggctaacaagaagacctgtaggggagcaaaatgcttgtgacttgtgcagtttagtcttcacaacaagagagagtagacttatcccctcttatatgttaccggtgaagacattgaggaatagagacctgttttgctcactcagattgtacttttcaggggaaggattcaatgcctggtaggtctgactctaaagccagggtttctcttgaaccagatctcagctctctttgaattcatcaaattggtatgaaggatttattatgcagagaatatttttaccttggacagatagtcagtaattgaagccagattccaaaggtggcaaagacctagataggaatgaaaaccatcttcaagtgttgtatatcctcagagggatttctgaaacattgtgtgttcaccagcagcattagttctcactcaatgtatcagtcatatttttccgcattacaaacaacctctaaaaccaagtagctgacagcaaatagcatgtattgtcttatttacaagactgcgggttggctgtggtttaactgatcaagactgggcttggcctaaccaagctggactcttggcttctgctgggcacaggtcttttccttctttttcatttcaggtacctgtctgaaagggcagtagttatctcggacattctctttccataccagcaaacactttaaaacttcacatctgctcacataccactgactaaagcaagtcagatggccaaagtcaacattgatggggcagggaaatatgttccacccagggtggcaggctctgcaaattcagatggcaaagataagcgaagaattgggaacacttatctaatccagcactctcagaaagtgatctaaaaaaggtgtcacaagagtctaatggtgttactgctcatgtcagacttgaagctatgtcctctgactcaacactggaattttaggaatgcctcacttgatatcttttggaatgtctttgaaaatgagttttaggatgatgtcctccagcagattttaattatatcatataatgtacttttaatcacaaaattgtatccaattatgtattatttttaatcataatcttagtccttcaaattcttttcatctctgtctcaatcagcaatagtgtggctgccattgtataccctatctaaaccatagaatagaagtcttgcccactggaccacccttttttaggcagattccacgtgctaccagcggatgaagtcagacagaactcagaatagagtgtcatggccaaggtctgtcttaagattcaaacatgaaaaggaaagattctccatgccaaatgttcacctcaggggagctgaacactgagaagttttacagaggaattcctagaattttgagggcagtttacaaactcaggccttcagggggcttgactatcactgaagagcaaaagccaatagtcaggggatttgagggctatctttctttcttctacactaagataataagggtgaatgctgctgagacggtgatgacgtgttcagcatgcctgcctctggagaatcatgcacctgtctgtgcctgtgagagcataaaagctccatgagacacaagtggtttacatcctgggagtcagtaacaaagctaagagaccctgtctggtgctgtgtccctgaaaggggtccttcagtctgtcctagtctagggatcctaggacacaggcctttgtcaaaaccccaagccaaggggacctagctgtcattctcctaggtcgtgtttttaagttgatcaaggtcacgtgcatggagtgtctaggccagcagaaactccagagagcagcacagaagtttgtatcctgccctccagtgagagggcttattctcataggcctcaggtggcacagaatcactgcaggatgctaggcagcctcctaggacacaggatcaggcaggtatttctcatgttcccaaatgtggcatgacaccatgttgagcacctattttgctttgagcccgaaggtggaaaggagaacaagacagacagagctctgtctcatggagcttaaattccagcagggtggacacacaataaccaagcaaacaaaacggacatcatttcaggtagtgataagagcagcaaaagacccctgcaatccaaggtgaggagtttagattttgcccatagtgcagaggaagccccactggggggctcctagcgtggatgtgacatggtgtgctttatgtttggaaagatcactagctaccaggactatgcaccatcgaatgccacccattcaataagcagaaactgcattttcatctctcagtagatcccaatatacgccttttctattcaaatgtgatgtcctcaatgaactcctttgattacccctgtagggaaaatgttcttttaaaaaagaatttctaaaaaccctattccaggtgattctatgagatctttcatctcctgtctcagaagacttatccaggggtagcaggaacagcttgcatagaatagaatttgtttcacgaaccatttctccagtcattattataattccttaggcaaaagatgatttcaaaaataccctccgaaatagacactggagctcataagtttgaggagctgatgaagcttgcatagattgtaaccttgtgtcctataaaaatgcagttcatttatacctgttttgcagagcagaggaaacacaacttgaaaggaaaacttcatgttttgcagttttttaaataaatgaaagaaaaagtgtctcaagaccaaagctgaatatagtagaatttatggagtatcatttgctttggcacacataatgtcaagtgaaatgaaagaatggtgtgaagagatgaggatgagaagaagtacagaatttcccttttccctttttatattatgactaattctagaggccctgctagggacatcagtgctaagttgaataaaataaaggaaggggtaagacaggaccatggggaaagaagcgatgtcacaaaagttctgtagtgagccagtgggccacaaatttacacgctccagtcatgtccagagtgatggtacctaaatgttcaagtgtaattgagccatcagaactgccagcttttctaccttctcaagagattccttgggccccacacacactctgcaatgaagacattaaatggtagaatgggtgctgtcacctgagaaagagggtagcacatctaattccatgggtcctctgggcatagcttatgcagaaggccatgtgtttggtgctctgaaacagctccctgcccacaggggcttccaatctgatttcctttctttggggtttcaaaccgtgtaacatccagactggagtgtctgacatagaggctttctggtatgttccatccattctgaggaccaacaacatgccaggttccaggctccaggctagggtatggagggggtgtgggctggtatactggtcctgtcccttgcttgagtcttccacgagccacttttcctctcctgtaaaatgggagatattatatacattttgaagggagttttcaaggtttgatttattttttgtggaagccagaggtggtttggcttctaagaatagcctaggctcccacccatgcccaccacagcatatcattactttctcttcaagcagatgcaagtccaaactgccttactgggttatattgagtctattaaaactgcatgacaaagtcacaccatactttgcacacctcttggcatttccttccttccttccttccttccttccttccttcctcctttccttccttccttcctttcttcctccctcccccttccttccttccttcctcccttccttcctcccttcccttcccttcccttcccttcccttctttctctctttctttctttccttctttctttctcctttctttcaacagggtttcactctgtcacccaggctggaatgcagcctccaattcctagtctcaagcaatcctcccatctcagcctcctgagtagctgggactgcaggcatgtgcctgggtgatttttattttttaattttgtagagataagatctctctatgttgccaagactggtctagaactccttggctcaagcaatcctcctgccaaaacatccccaaatgctaagattacaggcatgaaccaccgcacctggccttgggagttttcaatataaatccaaattaattctgttgaggtgatcagacccaacaccaggtcatgggggcgacgaagtccaccggagtcaaaggaatgagaaaaagtttgagagagaaagtgggaccagggagccatcacgagtggggaggctacgaaggtcccgagctctgggagccaaagaaacaggtagtgaggatgtgggggttgaaaggaagcagtgtatcaagtgaatgagaaacatatggctacttgagctaatgggagtgatagaagcaaggagccagcaagtctagcagatatgcaagccctacctcaacttctgtcccaacactcagcttttctcccaacaaattatctttgcctctttccctcaatacagtaaagtccaattacattgctgtccatttacagagcaactcatcttcctttttcttttctcttctactttccattgtattcttatgaaaattaaacgaggtaacacagataaatgctactaagtagagtgacttatacataataattgctcagtaaatgctaacagcagcggcactagcagcagtttattattatttcaagattgctgtcttgtctagtgagccaggtgtgcatgccaatgtgtgcctggactagatgacctttatactccccgaagtgaaatattatgttaccgtcgtgctgacagccagtgagctccccaactcctccccaattaattagctattttatagaacatttctctactgtgcatgtgctagaggttacaagtagaatacagtggagaaggggtgatcgcaagatcagacatgacacctcattgtctcagattcatcaatacattttgacagctgtcatggtttgactacccccaaaaagcagatttaaaggcaggggtttgtgtgtaagttgttaatttgggaggtgacttttggaaagagagacaaagaaaggaagcaaataaagaatgcattatcatgggatttgccactgtgggcaagtggagtgtgagctcactgagcaactctgggaaactataaagcacacacctcagcattatcccctgaggggtgagggagctgaggtgttagttaacccaacaactctcagtaatcattggttgaagaatgttttgggggtgccttgttccctggtcctttagacctgccctacatgtggcaaagtgagctctggccaccagaaggagcccttgggtaaaaggggctggcaccagaaggagccctcaggtaaaaggtttaagtcaaagcagcttgcaaggacacagcatatgccaagaagatacatgcagtgcatcgtcagcatctgctcttgttacccaacttatgaatatgccatgttatgtgtataatactcatataccaaagccagatcacaaaacagctgcaactccactctcttaacgacagactgtggccacctcacccttgcctactaggtgcccctttgtgctcctgggcgaagccagtgacacctttttagcattctgctgctgtgctcactgcagtaataggggcagtgtcactcttattacttcacctgttttatcttttgtgaaactcagcccttagccagaatggtctgagtggctggtctagcaagtgcttaacggtgaggctccttcagctcatttctctcaagtaatttgatttcattgcactatcagaattgcttttatgggttggaaggaggcctagggggaagaggttgacaaaagctgttttgagattaaaaaaaaaaaatgtattgcccagtacctgccatcacatcctccatctacaccctccaatctctcctcccgtgcatggtagggtgtgcgtgtgtgtgtgttcaggagaaattaaaataacaacacacaatgcatctcacatttgtatttcttttcacctgagcttgaaaagtatactgtttgatttcctgtgatccccacaacagaacttgtgtgctaagatggaaaaatattatggctatgttctctgaaattatcaagcaaagtgtaattttgcattgacagtcaatgttgacaatccctgttcaactgatgtcaacatattgatcaacccagtgatacatccttctcactcaggacaatcataggtttctatcagtgctgaaagtctcacgtttgataacttcataatatttttattttgagggtgtgcacgtgaataaaaataacacggtgccatgctttcctcattaaagagttggcaggaatagagagctcagaagtggatgtgaatttcatgtgcagagttcaagggagtttgatttttttaaactgctgctcctaacttctggatatttataacaatacagtaccaatttagagcttttagttacttggaaggctggttagtatagcaactactttctaaataatatgcagtctacacagggatttatgatttcataaaattgctggtgttttatcacagctttgggccccatgctcggctgggtggggtgaggatatggatgaaaaccctttgaggttaaaaccaccacaaaatacatttttcagctgaaaataaaatgattgagtgcataaagaatagtttttagatttgtgagtttcgcctggacattggtctctagagcgctgccttcttacaaactgcaagaaaggcagttaaagctgaggtgagacctggcaacagatctagaaggggatgttgacggaagccctgggcagactctgaatggtgcatggggttaaggttttaaagcctggcttaaatataccaaattattattataccaacattatgttcaattttattttaatttttttctagtgagaacctccttgaaatgattgatttaaagtatcaccatatgcctttctatgatatggtaatctatagccccaaatagactttcattttaaagtttaaaacaaaagctaatctgttgcttctgactccaaaaaggacagttttactggcagagtaagtcatgtctatctttattttagtggaatatgctagagttctagtaaacatatttgaattttatatcaggtgaacaaaattagtttctacatgacagcctttggacaaagttaaagataatagggaaatatcaataacagtaaaaaataaaaagtaaatagagaggaaaattgtccccagcaaagtgaaaaccagatttactgtagctgcattggaaccattctgggttttcaataattccaacaaacatacagtttagacatggggtagaatcttcaatgagtctttattgctatgtctttctgtagtgaaatttgatgaaaagaaacattggcttaataaccaagtgaaaggaaaatgtccacctaatgagttatttgatgtgctatggatgaaaacaactgtaaattcaacttgctgtttcacttctgtctcttttatttaaattgtcttgatggtctgctgacagaattggtcctttcttggcttaggaacatcactgctttgcagcgagaagacaggcaaatcataaaacttgtcttggcttctagttataaaaagtattgactagcctaaagctatctttaatagcttgaaatgtggtcaagagaatttaattagaaagtacatctcaacatgctaaataaatagatcagcagagattattaaaacacatcattttacactttcatatacttctggtgggagtgttattggcacagctgctttggaaaactggcagaatctcccagagtcaagcataacatggagtccagcagcccttcctcctggatatatactcaacagaaacacatgcttatgtccaccaagacatgtatgagaatgttcatggcagctttattcatattagtgtcaaactgggaatagtctagttgttcatcaacactcgactggataaacagattgtggaatatccatacaatggaatgcaacactacaatgaaataagctactgttatatgtaacaccatgggtaaatcaggcaggcataattttgaacaaaatatagacaaaaaagaacacacattatataattcatatatgtggagtataaaaacagacaaaactaacctttgatcatagaagtcagaatagtggttattttgagggctgggcattgactcaggacaaggcagctttctggggtattagaagtatcttataccttgagctgcataatggggtgtgtgtgtgtgtgtgtgtgtgtgtgcgcgtgtgtgtgtgcgcgcgtgtgtgcagtatataaaatatttgcaagcactttcaatacaaaagtaaataagaaaaaaatcatttatttatcgtataagtcaactttcacatttacaacaaaagttaattttatgaatctatgctaatgagtagaaaactaagctttggaatgccagtagaagcacagaatctgtgtgcacctggatacacacacatgcaactccctgcatgcctgaccctaaattattcatggcttgttcagcctcattgaccctcatacttggaagaaatttcccatgtcatctaattcagtgattcatctgaagcttgtctgtagcctcccctccgggtggccattctacttttgtgaacaaaagtcccctggtgaccagaatatgttgtgatgttctgaggaaggcctttttctcttggaagtccatccctaggctaaaatctgtctttgtctattcattggtcttatttataaccccggaggtcttgtagttaagtggagaaagaattgtcctgttgctgtttatcctgaacatcatgctttaccttgtatatccatgtccactgaaagcaggcatattatcagggatattcatcttgatatttttctccccttttaattaatcacaaaacatcttcctatgaggaactagattttcacataaatctctatatttttccccagggatgaaaagggatattctgaatataacaatctgttgagtaccttctcagcatcccttcctcctccccatactctaaggctaaacacccctgtgctcccaggagtgagccttttcctgttgtcaatatgtacaaagatccacaagtctgtaatccagtcagtcattcaacacctagttattgatcattctctatgtgccagcaatgttttaggtatccagtgataagcaaagacagatgtgttatctgcctcccagggttttcactctattaaggttattaatcacatatttacataaataaatgcagaactgcaactgtgatgggtctgtgaggtaaaggtacatggtattatgaaaacacaacatagggagtcatcagtgtcagagaagcctttcctgaagaagtgatcacctggcagaggacaaataaaatggatatacactaggaaaaaaggaggagaaatgtcatttcagaaagaggaaagagcatgagcaaggccttatgacaggaaggcaaaataaaaataccacattcaaagaccagaaagaaggccagtgtcgttgcagtggaggaaacaaagagcaatgcaacatgagatgagactagagagacaagaaagggccagcttattcaggggagaaatgttgccactaacttggggagtggcttgaagctagagtcggcttcaaatgattgtgatgcttgtgatgcttgtgaaagagtattccttggaaagtagctgagcaaacaaactaacgagaaaacaagttttgagagagctgtttaaatcagtaactttgaatcgggaatgttgcatcaaggtccagggcacgatccatggaggaagttgttgtggaagatgagcgggtcaatggactggctaagcgcggggtgggtcactcttgtggatgttgaaatcacgtggggttacagcaaaccttgaggttaagatgaaaaccataactcaatgccagatgctctgatgaatatgagagagtgaccaggaggtcacaaataattgagaactgaccatagttgccatggttctatgacaacttgtataatttctctgtggggaattatgtcttctaaaggtgaatgttaatactgatggtcattgcaactgagtgtgattgcagtatttattcgttttttatagccctataattttatgatgtaagtacttattcaacatacctaacatttggagaagaattttatgagatgagaataaataagagaagactgagaaataaatctagaaaggccccctggggtcattggaatgtgtaacacaaagctaaggtgcctgtgtttattctgtgttggagagtcaacaaaggctgcctctgttttgtgtaaggttgaggtgtaatgctaactatgcctatgcctaggaagaatcacttgaaagtggcttgcaggatagattggagaagggaaggaagaccaaaggagcacagctgtcaactacagttgtctgggtgagggccgatcagaccttgaatgaaatcaatgggaaagggaggaaaggaaggggcggtggaaaatagttcagagggacaatgcctttaggacttggttaccaacaggggagtccgtcaaacatggcggtaactaggagagaggtaaagccatagacagaaaccagaaagccagggatgacatttgttttaggtaggagcatgtattgcattgctggtgctgaagtgtattaaagggaagtatccaggcgattataaatctagatgttaaattcagggcagagatggactgaaaaggcctcctatggttaatcccctaacaggaaatgcccatcctggcctccttctccttctttttttttgagacagagtcttgctctgttgcccaggctggagtgcagtggcataatcttggctcactgcaacctctgcctcgcaggttcaagcaattccctgcctcagcctcccaagtagctggcattacaggtgcccgccaccacgtttggctaagttttgtatttttagtagagatggggtttcagcatcttggccaggctggtcttgagctcctgacctcgtgatcctcccacctcggcccttcaaagtgctggagttacaggcgtgagccaccgcacctggccgcctccttctccttctttgcagctcacccgtactctcattctgcttttctctcccgttcatttttcctaacctttcccattgattcctcgggactcacagcttatttctgagaataatgtctccttggttccccattttacagccctcttcctcaaatattctattatttcctgcaagcctcacacttctttctaacttagtcctctttatctgtgtccacatacccctaatacacttgtcatgctgcattttgtttgcctctttacttgtctatttcctcccctagactttgggcttttagaggacagggactcattaaaagtatgacatagctactcgtgtggggttcagtaatactttttaaataaattaactgacaattaactttaaagaaaatttaagagttttacattttggtgcattcatttaaagaaaacgaataggattaaacaattcataacaaatgcacaatcccaaatgtggtagacattgcaaaggttcaagaacttacgcacattttctgtataacagtcattgtctctaagaaaaattaagcttggctctgatttgttttgtcccctttcttaatgaactctctagcaaagcctgtagaaacctaatcaggaaagcaacacatattcttggaaatggggacaatatctgtctttttcttgtcctctcactcattttttttctgaagacgtactgagatctgaaccatcagtttgaactactagaatacatatttgccctccaataaaactgggtcttttaagtcttggttctctccatttccgcaacgtctctctctttctgcgtctgtatggaaaatgttccaggagactctggaccagaagatatcctcatagacaagccgtataaggaaaaaaagagggctgagtttaggatgctgggaatggcacacatttaatgaatgccgctagaaagaagccaggaaagaattggtcaaacaggaagaataagacgtggaagaaggcagggttgaaaaattcaggagaagaagtcacacattcatcaagacagaagtagattaatggttaccaggggctttgggtgacagattggggagtgaccgttaatgggtacagatttttgttttgggatgataaaaatattctggaattagtgatgatggcaagactttaaaaacatggtacaaaccactgaattgtaaactttaaaacaataagtaataaagtttaaaaaataaaaattctgtgagaggagaataaaacataaaaaaactagtcaaacacatctaacactagagagcttgaagataaattgaaaggtgatgggatttggtgattaggaaggcagtggtgagctcaaagagcgtagtttcagtagcatagttactcctatctcttctgcttcctgctctgtaaatatatacattgataaggttattccttcacataccatcactattggcagaatgtttgatgactctgcaggtccaggaatgtgtttggtttagatcagctatggtgacattctgaatgtgttttggagactctgagcatgtacgcttctgctctttgggacaaagcataagtctgtcattcttgctgcccttctaaaaccaaacctatgcaacaagacctgattatctcatgctgtctcaattccaagcatcacctctgatggccccaagtgaaacaggaaataccctctttgaattctgacaataagtttctgtggtatgtttcattggtggagttctgctggccttgtgactggcagaactgaccctggactaactgcatgttttctctgagacacatgtactttttttttaagctgaggataataaactttaatctgagcacttcttacaagaaaataatatgaaagtatattgtaatctattatgcatatgtaaatatgtttttaattgatattgttataagattagagacacaattaaattatttattgtctttttgttttttaaactctgtactggtgtaggaccagccttcttaatgcctgtgtgtaggatcacaggcttcatatccatgtacatcttactgaggcctgtacttattggttgaactgaatgttgtttaaatgagaaaactccagtatcatagcgtgattagcctcccttttgccttcatctttcgttgttcatttgttttttcctgctcttcatctaggctttcccaacgagcctgctgcagtcattgccctcaacaccattaaggaatggcttgccaagaatcaccatgaggtaggaggaacgacataatcagtgaacatccaagatgatgtaatttgatgctcagttccccccaaaaaagcacataaattttataaatatcaactacacctagtcattgagccaaacctagctgaccattcttcacttgggttacatgagtaattaaatgttttttggtaattgatagaatgcagcaactctattgatctatctggtgaagtgaccagattcatttagccataatctaatttttttacattggtggatagtatgggttatatgtgtgaaaaagagaaggggatggatttcattaagaataaggagttttcctatgctattttccttaaagctaagttatctttgttgacttgaggttcctggtgtacagtaattgtctggtatctgtgttctttggatttataactaatcacttccctaaagtcacttctgagtgtgagattgaagtgggcttgtataattgatcacaaaatcgttatgagcgggatttcttatgaaactaaataccttcatcagagtattcatcatcctcctattctgcttacttaataagatctttgtgatacgtttagtgatgaataggggaattactcaagtaaacaaagcagcaaaataactagagaccgtggagcgttaaatttcagagatttgtcagtttacatattgtaacagctaggaggtttcaggcaatgcacagtcttatgcatttttcttctgattttgtttttctcctcagttattcacataagggctataaaaattgtgtttcattttctgatggaccatgaatttagctattttccttgggtaggagatgaattatttggaaataattagatatggaaacaggtgacggggttttcaaatgagaaagcacttggtacttttgtgtgtttgaagaaacagcagtgtcattttctaattattgtaatttcggcatttgttgaccacgtggccaaacctatccatttgggtgcttaccctttattttcttcttactttgaaatgtataaatatggcaacttcaatttaaaggatatcttaaatcacctaaaagaagcaggagaaaaacaaatagctaaaatagccagcttacaaaacatgtctttgacacattttattttcttttcacaacaaccttatgaaatctctagggtaggtatatgttatcttcatctgcatttgccttcaaaaggttaaatgacatactcaagattggaaagtcacagagccaagagactaatccagctctcataactcactggacgttcctcattggaatgccaccaaggccagaaagagaaactcagttcctttaaaagccagttatcttcaatatattgcttggtcatagtaaatgttccacacctggattaactgctttgcaaaagtgtagcatgttgcatgagtgaaagttgataactgagcaagcgtatcagtgcatatccatcatttccactagaatagtaatccaaggatatgccccactggaggaagttttcatgcatcatcttgggatgtgatggacatatgcataaagtcatatcatcgaggatgtagtgatgaagaataaacatgttggtcacaggtacatctcatcaacaaattctactcattgattctctctagctaaattattcagaaagttattttccatagaaattttctaatctagtgttttctacttaattcacttgcctaccctatctttgagtccattcttttgctttcatatccttttatttttctgctaatttcttgggtccattgtagaaaatatagataatttggattgagaaactcagttattgctattgcaactgtaaacatatcctgtactgattcccttttaaaaaagacccctagtttcaatattctaatttaagcaagtcaatttgaacatatcaggtttttctaaataaatgaattataattggtaggtcttagataaaagctaaataaattgattagcagtattttgatttattttttcctctgttaaaacaaacaacagactaggttaaggacttataaaagagtattgcttctaattgttttctcttcattgcagtattattttgatgttctgattggttaagctacttattcattaattcactcatttgataaatatttattgactccccctaagcaacagatacttttttatattccagggacagagcactgaaaaacaaaatccttgctttgtcatattggtagtctagaaaaaaaaattatgtttgcttaacataaattaagcaaataaaaaataaagaaatagggaagttcaaagagtgctttacaaaataaaacagggcaattggagaatgtgtttttaggtagacgtgctgaggacgtaatcttggaatacagatttgtacaatgggaaggaggaagccaagccatacagaggtcttgagttaaaacattccacacagagagaaccataggagaaaagcctggaagagagaatgagctcactgcttgctagcaatgatgagacccaatgtggttgaagcagagagacgaaagaatggcaggagacaagtttggagaaatagacagagtcagattatagggtcttgtggttcatagagagactgtgaattttattctagtgggtagttgttgaagtgttttgggtaggagaataacacatataattcaccttttaaaaacaagcctggctgctcttccgaaaaggatatcttatatttataagatatcagagtaggaaatggcagaccaattaagaggatgctgcagtaaatccaggcaggagatgagggtgctctggaatacagtgatggtagaaaaggaggtaacaagcgtcaagtttggggtacactttgatgatgcagccaataggactagaggattgttttctgttaggatagggttatgctgcagttacaaactacccccaaatcttggtatcacaaacagcaaaggtatgtttcttgctcacactgtttgtacgtcttgagtcagcagagggaactgacttacaaatccgggctgacagatactttaccatgtgaaatatcatctatcacatgacaagaaaagatagataatcaattcccttgtagaaatgtttctacaaaggaatgatgtatataactttcactcacatttcattgtccagaaaaaggcacccagggactaagttccaggagacaagaaaatgcagcctttttgtatgttcagaatagagcaaactgaatattgacaaaaattagtaatgtctgttataaatgtaaatcagatgtgatatatgacaaaaagagaagaatcaaggatgacaactaaatttttggcctgagctgctgggtaaattttggtgcatttactgagatgaagaatattggtataagagcatgtttatatgaaaaatataaagaagacaagaattgtgttgccatgctacagatagttaagtctgaaatgattttagatatctaatgaagatttcaaatagacaattggctcttggagcctaaagctcaagatagaagtaggaaagaaagaccgggtgatattgatcagattaccataactttaacttgggttcggcctcagtttgagattgcttgcaagaaaaaggaatatagtcaaactagcttacataaaggagaatgtgttgtataagtgaactacattcttaaaaaaagtcttgaaatccaagggccggaactagagaggggtctcatgaattatagaatcccaaactataaatccaataagaaccaaggtagctcattttcattctctcccactccatctctatctctcccatgtctctgtttcattattattatcatgttgcatgttatcttttattctcattcacctgcttacgcgtggccccatcatgactgtgtctgtccattcatgggtcaatcagccctgcttgaggcaaggcctgggttcagtggataaggttgcattttctgaagctcttagctggtgaggttcccccaaaattttcctttaaaaaacaaaaaagaggaatctatgtaatgtgagtctcccatcagtgctcatgcttttcttattcagctgagtttattattcaacattcacaaatttcatagtttgtggctatcattccccataaataattgaggctgtcatataattgatgagcttttacatttcaccattaacttactctctgatttctaaaccatcaggaatgtgcactttttctttcccaacacagtagttgatttgcttatgtttaatttcataaatcaccgccagctggtgtagctggatacttccacacccagagaggtctgactagagtcccagtggtcaggagggggaaaatcatattctgttgcccaccatccacttgtttaatttacccaaagtctgaactccaagggcacagcatatatttaagaggactcagaaacccgaggggaggaacgctgctgcacacacagcacagtggctcaaacagtggcagctctagcagaagagctaaagcagcactttaacaaaaagaaaagaaaaaaaggagcattctcaaaaggctgtaattgaggcacaaaaatgacttagaactgaaaaacatgatgactcttgagttgaaaatcttaaaaaaacaaaaaagaatattcactactgagaaccgaattattgctatgagaagatcagatagatgaattatctcacaacacagaagagaaatacaaagaaatgacaatcatgactgaagaggtaaggtggcagagaaacccagggatcaaacatgaggcaggcagggtctgaagattacccactggcattttcagctaaattaagtattaagaacttctgagttcagaaaaccaaaagaaaagaatatcagagttggcagtaaaaattgacagcaggtagcatgataacctttctctaagtgcaccatttttctcaagtagtaactttattacagaaataggtgagcaaaataagggactgttatggaaatgaacagtagaaatgtggcctagatttctaagttggggtggctgctctgtgttatcaaatgcaatttcatgcattccttatttttcatgcaatctagaaatataattctttgcggaataggtatttccccactctgcagctctgagaccccctgctcatatctgaaagttagcctaagaaatgtttttacagtgcctgttctattgttctaccccagggactcatatggcatttggctattggtctctgagacaatgcacatatttgccattttttccacagaaaagtagaacaggatgcatttcacccttcagagccacaaatgtcctgatattgtgagacatttccaagtcatggtggtcatattcaatatttcagataccccaagggagcaagcatcctacagcacatagcaccatgtgttcgttttcccaggaagtcctgctagtcagggaatacggcttctaagatgacgattctgagctggaggatcagtggatttcccaggaacttttaaatgtggaaccctaaagtactgatcaaggattagttgtaacatgaaggaaacctgaacccctctcctcctaccatcaattataaagaagcagatagatggacagaaacccagcgttctaggaggctctaggtaaagctgtggccacctgcagctatccaaaggggagcccctggttcccctgaggcccggccccagcatcatctctgtgggctgttgaggatggactccttcccgctgcactactccaagggaattccctaatatcctccctcctatctatactgctctcctccctagacagatcccattgctctgggctggggacaattcaatggagaagtgtttggttcatctttgaaggcctttggctaggtcacctgcctagacttggaaatcactggcaaggaaaaaccccagctctgcattttcaaaacccaaatgggttttcttttatataggaggaaggtggtacttttctctcctcgcgtacaaggtttgggtctttgcccgacataattttttttaactatgcctttagcacaaacagattgttgttcaaaatgttaaatatcatctacttgtcatttaaatagtttactctgtgccttcggagggaaacacaacacctgtggtattgctgtttgtcacttaaagtagcaagcctacagatgtggcaggggatcctgagatgctgtatatgtgtggcagcatcgctctgagacagatgtccagctcggcaagttgatgccagccaaggctcccagacctcacccagtgtggtctagacctcaccgtaagatgccgatagccagagacaaaattagctttgagttcatccttgatgtcctttggaagtagagacgttggtttctactgcgtggaagcagttagccttgtcaccctcccttgccttccagtattcaggcacatgattcacaaactgctgaagaagctgaacatatttctccaccccagaaaacagaattaggaatccactgtagaaatgcacgtccagcctcctgagtggttcagatgctgctctcatgctgatttgacaagatcgagaacacagccacttgtttcctcattactgatcacaaagaaactgttgcactttaacttctggtgccaagactatttttcccccttcttggcagaggtctttgagcatatgcagtgttaaaaattgtttgccacttttatttcagcatcacgttatggatcaccgaaaaaaaaccccagtgtggggcctgccttatgtctctgacatgaaacgccttaggatctttgtgattcttaaaaagggggtttaaatgaaacatgaaatgatgcttacatttatgatgggaaaattatatatttcgaaacaagctccaaattcctgtggactattatttacacttatgcaaaaggcataatgtgccatcctccaattctatgcaatgcaggggtgtggttaacattcagagacctggaaggagcaaaggaaatgctccgtgctctctctcaggaatgcctttttatgtccacaaacatcatctgagtacctattatggtcttagtttttggtggaatttagtgttaaaatttgtgcacttgaaaaaataaattgcagctttgaaatggtcacatcctatgcagtaatgtggttatggtaataatcatcatcatcctaatatgctgccgtaaaaacgtatcctttgagtagcccaaatgtgtcgttcaggtggagccatgacactcataggctgtgacaccactgaggacagttagtcccagattttgcagatacgctgtgtcgcttttgctcttcaagaacactgatgacttgctaacattttatattttctctctacctctttatttttctctccctctctccctaccgttctctttctctctcactctcctttcttccctcctttccttctgtctccctccctctttcttccttcctccctcccttcctgcttctcccaattccctcctccctttttccttcctttttctttctttctccttccttccctccctccttccttccttctttctttctctctctccttccttcctttcttccttcctttctttttcttttttattttcttcttttctttccttttcttttttctttcttttcttttctcttctcttttctttttctttctttcttttcttccccccaccagcccgccccagcccagacaatcccttatcactctgagtctgtcattgtcgggatttgtgacaagcagttattgttcccacggttagaataaaagctaatccccaaggcagcttctccccttctgatgggggtgttccagtgcttggtgtcaccatacactgccacacaagagtttgccaagtggacagatccaccgacacttccagcttcaccctgctttagcatctctcacaattggcataatgaggttttggagccagaaactaaagccccaagacaacatcaagggttgctttcaggctccatagccctgttgtggtcaataggaagcacagtgcatgggaaaatatgcattttgctgtttcagttagtgagcttattaccagttagccagtgatggggagggctctaattacacacttttaggcgttgagctgagcttgcccaaatgccctgtcacccattcttactctggtggggagctcatcaaagttcaacaaatgttttgttttatttcctcccagtaggggatatcaggcaatcaaggccttggggtgctctagggacaccaacctacagtcctatgtagattagggtggcttgctgtcttctgcacttgcatataatcaatatacatcctcctcagccagccctcctgaacctagtactatgtccattatgccccactgtatctagataaacagaatggagtgcatgggaatgcagagagaacctagaaaaatactctgctgggggtgagtggtttggggggttgggattttgtttaaataggcatggagggtaattcatatatactgctaataggtctagaccttctagaaagagttctaggaggtatagaataggtacatgaaggagttaaagagggaagaaagaggtaagggaaatcaatatttatctgactcctgatgtgtcccatggcagaggcatggcccaaagatgcattctgtcttcacaaaactctcttcaaggtagttattttaaaatctttaatttcctagatgtgacagttaaaggaaattttaaaagtcaactaataagatactttcatgttctactataaccttgcttctgtggcctgtctagcgttgggcaccttacccagatttagccatacatgagaataaaaccaaaatagattgattagggtctttccatgggatttctttgccacctggagtcaggaataaaaaatggtggtgaacctgagggatgtggagcacagctaccgtgttccctaccattttggaaggttcttctttaagaagataatttgaagatgtcccagatttgagggcagttggcaagagtcacagaacccattctgttggctcaagtgaagaaccaaaactgaagcaaaaagcagtatattttagcaaaatgcaatggccacccattttaagtttttacaactcaaaaaataatttttaactagagaaaagaaaaggttgagaatcatttggagggttatttttttcaaaagtgtatgctttaaatagtttattctactcctttcagagaacctgtgctatgttgaaccactgtttatgatgagaatattttacatccttcagatgtgttggctggaaaaattttgagagtcactgtcctaaatagtaaaattagagtgctttttataaaatcagtctttcaatattcccttcatactggaggaccatcaaaagatagtaattaactaatgaattaattttctgatggctgtatttttctccttctttcctgcaacctggaggtaggaaacacacattaacagaagccagtgctgaggagagactaagaaatagcatgagacaggtgaaatgcaaactctttaaaatcaaacttcagggtgcaggtattaaaaaaaggagagagaatgcagtttgctcagatgacttggccaggatgttcctagggttgggattggtatatctgaaaaagaacggatccctttgcaaagtttggcttagaagttccaagcctgcaggaatgtactcaggagctcactatgtaacagaagctcagctcctcttccgtgcagcaggaatgggaattgtggctcctagaagtagagtggtaagaggtagggtgcagttataaccaccactgtgtaccctcactccaaagaggaagtttggtgttctaatcagaattttccacactcttacatagccttaaacaattaactccatctctctggactcagtttcttcatctgtaaaatagggagggtgggcatgtctcttctagcttcaggattctgtgccattgatgtgtgtcttctggagcaggcccactgatgcatcctggccatgcctttgaccatgtcttcatagcacaatcagacctgtaagaaggcttacactctgtgattctccaggctcctccagtggcataccaaagatcaagcaacatttgcatgtgctgtctgtatgcctttaagatgattaccaacccccatatgggtgtatctttagagttgatattaacaaccttgacccatttagtgtagaaggagaggccgccatgttgattttctgtaaatgatccggattatatggtggtttcaaaatagccaacttttaaagctccttatgaaattaaatgtgctgattatccaaatgatgtgacatttttataaatagaaagtaaacctctgagcatgtggttggaactacatcagacacagggataaaaacaacactgggaggtcctactgaaggacattctaacaaccattttctggagatagaagcatgcaccttcatcccttctaggtaggaaggaaaaagaaaccttttccttgtcctctaccttgatggactaggactcgtatgctgccctgattgaagggaaaattaacagttttgatacggtcatctagctcaactcagggaaaaacaaaaaaggcatttcccctttctagtggaagtaaatgatttgcttgttgatgggtgatgttttcagccaggctgctgtttccgatagaagctgtgaccagagctgaaccatctcattgtttctctaatcacgtctaggcaaagaggtggctcctctggaaagactagactcctttgatgatgccactgctactcactagggtaagaaaaccaaataggtctggcaaaacacttgcttctccaatttcatggctcaatggaaaacatactggaaaaaacatccgaagactgtgggtctctggccatgcaccgctggaggctgtaacggtgagcccagtgacagaagggctggctaacgtgctgtcctgcaatcagttatgtcgtctacatttctatttatgaaccccttcgaagtccatgacagaaagccccaaccttttagtgaggagactattcatttgcaagaagcagagaatagaagaatattgggggatctactattaactaaacttgtgttgaatagaagttactaaaacctggtcagattcacatctgtgattccaggttaagggcctcaggcaaggaagcgaagccccacgtggatcctgaaatactggccttagactcgattccacagcaaaggttgcagccacccagcatctgagctgctgggcaccagggcaagtgatggccagtgacaggaaggagctatgcacgcatatatcctctgttgtgtgcactctttaaaagaagagataaggagaaaaaaatatttaaatgatatcatttaagtttcacaataaaccattgactgaaataagacatatgaattctcttttcttccaatcggtccaaattttcacatgttccttagcttctttctgcattgatgtgatgctaagatgtaaagacttttagttgttgttgcttctctgacactgctcctcgatataagcgcaaaacttcaccttttgatcatggggtctttaaaaaaaggcccagcaatctcccctaaagctggagacaaaactgggtttcctggacttactgagatgtgatgtgtcagtttacaacataaggcctttctaatgaattttaaagaaaaattttgctcatgtgaaattttcactttatgtgctgaccttagagcttgaacattgcataagaataactcagctgtatatattttgcaacataaatgttgcctgtttgtaaccagcagatttcccttaggctgggcggcttcttctgccctgttacctactgaagtactcccctaatgaccaagaggttgctcagcttgtcagtgagacaagaaaattcttggagatgtgacaatcattctggacctattcctcacctgtaagataaggtgaaagtcatctaggaaaaatccttaaatcagatactggggcataccctaaatctactgtatcagaatatctgagaagatagtggcctatattttgaaaatttcttcaggtagtggttgagaaagattaggccagttgctctcaacaatcttttatggctaagacatactgcaataaaaactcccatttgttctcttcaataaggaaaaggctatgttaagtgagaactgtgagagtaaatctctcctctcaaccagtttacgactggccttctaacaaggggttaggagtctagggttggggctgtattgtctagctagtcctggggtggccacagcttactttctactcacaagcacttgacatgggttgaccaataagtgagtttgatgaagtttacacataatgtaactcaactcacattaaatatctttgggagttgctagacagcttttgtggcaccctgtaaacagtagaggccttttgccatcttttagaaaggattttagtatattcccaatatcctgttgatagtaatcattgtctctggatattgcctttgatgcctctatgcaagagatgcatttaataaattactaaaaatcattagcatacacaacttaattcttctttgagtacttattgtaggcagatttgaaaataaagccaacagggctatctcatggatcttatgtaattatattggttcctgaaacaacttttgagagtcaagtactcagtcatctgaagcaaattaattctccctggacatgaaggtgccattaagcatagcggcaagagatgattttccggttggtaccctgttgtcctttactgaagccggtttacaccaccctcatgtgaatcagaccctggatgtggagatacgtgccacccacggtgcttctaggtccccccaccgctggcacaattagatttctttaaggaattaggaaatgaaactctatattaaaattcattgctgagaacactacctaccttaatattttctgctgttcaaaattttcctctgaaaacaattagaggctgatggggtgtgcatttgacagtgcaaatggagctacaaatgacctgggtgggcttcagctaagcacagggcagcttaggaatgtattaagtggagtaattatctcatatggttttcccttgggttcagtgacatctacaaagttcgtttttctaagttcctccttctacaaatttaaactcaagggaaataggatccatatgtccctgattaatttgcactaactcatcaaacgttcttttctttgtaacttattagatgtctacagaggatttcaactgttttttataagttctttcaagcctttttgtctagaggcaggaaatggccatttgccagcagcaagcgaacccctaaatagtcacgttctgttcgggagtcaaaggaaaaagaaaatcccctgttttctaagtacagctgggtaatggttttctttagaggtgatgataaatgtattctctgaaatgtattattagacttgttaaatgtgtaattaaagggattccatgaagttgttgcagcaggaatgggatttaaattgcccccaaacccccttccacacacacattattactttacctgtgaaaatcttaaaagctgttggtttacccagcagcttagagccttgaactaagtgaaacatgaaatatcttcaatatatgtaccagaggctctgcgtgtgtgtgtgtgcgtgcacgtgtgtgagacattgacaagagaaagattgatatactcaaaccctacatcatactgtttttcataaatttccatattgaatccaagagacctcattttgaggatttaaaataatgtggcatcttgcttcattaccaataaaagtaagctttttggcctacccataataccccagggtaactggatttcaaaagcaaatcaacttgagcttggtctttcactaactaaaaatacagtcatgtgccacataatgacattttttgtcaacaacagaacacatgtaaaatggtgatctcataagattctaatgaagtagaaacattcttttcacctagtgatgttctgatgattctgaactgatgtgggcctaggctaatgagtgtttttgtcttcatttttgtaacaaaaaagttttaaaagtcaatgaacagatttaaaatgttaaaaacagaaaaaacttacagaataaggagataaagaaagaaaatatttttgtgcagctataaaatgtgtttctattttaaactgtgttattacaagagtcaaaagtttaaaaaataaaaaatacaataagttaaagttaatttatattaaagaaacaacattttcaaataaatttagggttgcctacatgtacagtgtgtataaagtccacaacagtgtacagtaatgaaccaggccttcacatgtactcaccactctcacccactggctttcccagagtaactcctagtcctgcaagctccattcatggtggatgccgtatgtaggtgtgccattttttaatcttttctactatacttttactgtaccttttccatgttcagatatgtttagatacacaagtacttatcattgtgttacaattacctacaatatggagaaaagcaacatgctgtacaggcttgtagcttaggagcaatagtctgtaccatataacctaggtgtgtggtagtctgtagcaccaggtttgtataagtatactctatgatgttcaaacaatagtgaaattgcctaatgacacatttctcggaatgtattccatcattaggtgatacataaccatatataaatgaaaaataatcacaggcattgaagtattgagtgcttcctttgtctaagtaccttacttgaattaaataatttaattatcacaaagatgctatgttatagtcataattattccccttttttgatgagatgagaaaacttagactttaaagatcatacagcaaataaatggcagttgagtttttaattcagaattccaagttcataactacaatcatcaaaagcattgtattttcccttaatgataaaagtaaactaccgtatcagagatctcctttcaatgcttatgaatctcactacagtctaattcagatctcttctagcattatcccatgtcaccctccatgctgcagctcatacaacttagaaagagttgcttggtaatttatttgtgaaaccaagatggcaggtccatggtttggtcaacttttattgtcttgcctttagcacaatgccaggaccatactcattgcaagttgaatgaaataatttacaaatgggaccttttattatccagcctgctgctcttataagctcctaaggcttcatgtgattagaactagagctgaatagtcatttgtggtatcaacatttctaagccatggatatttccattagttcattagtcaaacatgatcaaatgattaacaagcccaggaaatttcaaaatctccctgagagcaggaccctaatagtgactaatttctcagcgatcagtgctgcctttgttgcaaacacatggctcttgagattacagagtaaaatctgtacttactcctgttatctctgctcaaatactgcatctttggtgaatttttccttggccttaggaaaacttttcccttccaaatatcactgtcttttactgtggttgtggatgtacctgtcagctttcccactgactcaaggactgcaattgtgtaaattcatccatgcattgtttttgttttgtgttttaatccaaggagcctggcacataaaaagctttgacaaaaatgcattgaatgaacgaatgttttgaattgtttcttaaatgatggagctgagcatgtataaagccagtgtatctgtctcatacagattaagattcaagccttgaactctgttcctatcctcaaatgaggaaagggactgaaaaccagccctagtgtgcagagattcagccagactctggatgtagcccaggcttggagaaaattctaccctgctctttcctttatcttggacagatggcagtgtgctggagttaggcagctttagactgttgtctaaaatgggaagcttatcctcaggacaaattggagacagtcaagacttcagaaagctcacccccaagcctgagcttatgatctgttgatctatagctgatgggcacacggcttaccccgtttgcctgctttgctttctcttttcctgcaaaggcttgtgtgattttaaacaccagacaaccttggtctttaggtaactgcattatccttttttcagttaatctacttttaatttttctctctttttttagtccactcaacattgtcaacactgtcaaagatgtcaatgttttcatttccagttctgatgatactattttttaattgtcatgtatttccatatgtaacctgtttctgaaaggaaaatatgcccttcaaaaaaaatgttggcagcttagatttcatgtgtaattctttcaaaagcctctcagtctttatttatttatttagcaaatattcactgagtagctggcacaccctaggcattgcacactatttatacaaaagcagttgatatacaattcctgtcctaagaaagcttacggtctgttggagaaaacacaaagaggcaatgatcacaggataatgtggaaagtgctaggataaagggtgcccagggcagtgcgggtgctgggcagaggacagagtcaaggaagactctgggtgcgttctggtttgaacagaaggtagagggcagcctgaatgtttttcctggggctttttcttttccttgggagtgaaatccaaatgcctgtcttaccacaagaccaagaacacctgatcctcggtccacagactcaagaggtctcagagagtttgtaaatttggggcaaagtttacagttattttcactaacctctagttaaaatttagtactttctcccatcatgactgtagccgcaaatcacagtggtatcagcagtctttgtgactttgttatcagtagaaatcacagatatttcctatcacataacagttgttgcagagatctcaaaacactacttatgctcatcttgactttgaattatggtagacccaccataagatcttgtttcaatgtgttcataagtagtatgcaacgtaaccacataacacattgtttccttgtaaatggtatctcaaaaaaaactgtttcttttgtaatcttttgtatttttatttatttaaaaaccatattctgggaaggatccataggttctgctcaactactgaagaggtccatgttactaaaaagtcccggtggccaccacataccatttctcccttgctcctaccctccagcctccttggcctctgactccacccgtcaccctcatgctccaggccaccaccacatttgcaggtccccccacttataaggctcttcctaaagctctctgctcacactgacttcttttattcaggtcttatctcacacagcacctcttcacaaagaccttttcctgaacccccacacaaagtagacctgccctcctttcactctccctcacttcaccatttgatttttgtgtacaattcatcgctactggaaaagcgtatatgtattggtttatcggctgtcatcttactagagtggcacctatatcagagcaaggacttcaaatggcttgttctcttttatattcccagaacattgaacaatgcctggaaggtagtaggggcttaataaatgttcactgaacaaaaagtaataaatgagcgaatgggagggggagtagagaaaggggtatgccagacagcaatcagcgacaaagatgcagaggtgacaagaagcctgaatccaggagcgtttactgcaaagactgacagcaatgggccccttgtgcgcagggtcccttggccctctcactctttcctggcccctcagcagaaataaaacaggctcataggactctttttgataagagtagagaatacagtttgaagaactcatagtcttaacagataaatctggaaaatgctaatggagcaggttgccgagccatttcttattgcccaaccctgctgcctctttcacctagtaaagatgaacagacatgatttgcataacgtgcaggcacagaccatcaaaagtctggaaatgaatagagctggcaacagacattcttttcaaaggcatctgccataaagctagactcctgagagaacttgcagcatacaattttgggtgcccaaagagcatgctttatgagggagaaaaaaggtgatgggttcattgttgccagaatgtagtgtcttgacacacagtttgagatgtctgaatctgacatttaatagctgagatgatagtggtcaaatacttctcgaggtcagattcatgcagagttcctgaaaaggtgagaaatcactgagatctgtaatgacaaagctgatgagaagattgatgaaatggtggtggcaacaggacaagtcttcaaaatagcttgtgaatgatttattttgtagcagcagagccaattgacaatagcggattgctaattaaataccaaccactgggaaaataccataaatttcttttggctcagtattggcaattgtgtactttgaagcagaggccaaattattttccagtgagtgcttcattttagacctaaattttgtgggcctccatctctttttgctttcccttcaacctccagcatatttgatttaaaagcaaaaaggagaagagggaagaagaaagaaggggaagaagagattgaagaagagaaagaacaggtgggaagaagggaagaaagagggaggaagaaagacactcccaagtgtcctaataacatcctatcagaaaggcttatggccacgtgcggtggctcacacctgtaatcccaacactttgtgaggctgaggcaggaggattgcttgaggccaacagttcaagaatagcctgggtaacattgtgagaccctgtttctacaaacaataaaaaaaagtcttgctttcattcttttccagtctgtggctaattaggaaactataataactacagtttattgagaacctatcataagattggtgttttgctaagtgtttatgttcagtaagagttaacatttactattttctatgtgccggacattgtgctaagtgtgaattctcaccaggacactatgaagtaggaactgttaactcgctctttccttccttccttccttccttccttccttccttccttccttccttccttccttccttccttcctttctttctttctttttctcttgctctgtcgcccaggctggagtgcagtggcacgacctcggctcactgcaagctccgcctcctgggttcacaccattctcctgtctcagcctcccaagtagctgggaccacaggtgcccgccaccacacccggctaattttttttgtttgttttttgaattttttagtagagacagggtttcaccgtgttagccaggatggcctcgatctccttaccttgtgatcctcccaccttggcctcccaaagtactgagattacaggcgtgagtcaccgtgcccagccgtttctctgtttttcttataaatgaggaaactgaggcagatagtcttgtttgaaatacactgccattttttaatgagtgtgagaatttctgtaaaacaatttttaaagaaactttttatatgaaactagttgataagaattatagtttgctaagaaatacaattgaggcaatttaaggagaatctgtaagataaataagccgtatatttaaattaactgctggctacagttaggaaataaaagagatggagtcttactcctcaaatgagtaaagtgcgaagtgacctcagtttagaaagcagttaagatgggctggaagaatgaggtaagaatctggtacctagagaagccttatctccctctgtccactctctggtttgcactaggttggagaaagccattcttggagtcagggattaatgaatgtgggaatgcagagcaaaatgaggttgctctccccaacagttccataatctgaacctctatagctgattgtcaagggccgacctgcaaaggcttttgtggcaaagtcgaggagaagcctagaactccatgcgatgcagaggagtctcttctgttggagttaggggaagcggcgagaataaaagaagcactgcaatcaattccaacaaataaaatgagaactgggaaaacttatcatagaaaaatgaaaacttataatagaaaaatgattaatgatgaaaataggtaaatgtttctttaaatggctttttggatagaactgatctatttttttcagttaatgtagattaccatttggtggtatcacgaagcttttatgtttaaaatccacactgggaaaggactaaataaagttccacatggatgtcaggagaagaacctgtcttataattttgtgaagtgtctagattggggcaaatacccacagggagtggttatggcatggagaccttccccaacatggtggaaccacactttctggagcgagtcaaagtgccaatgaaccaaagtgaatgcagtgataactgcaagagcaggccatccatccctttcaccctggggtgatgactatagcgatgccagcgtgacattgaaaaccaggacacattaacacatttgtcacccctatgtttttaaagcttaagaggagcctagagcttcaagattccctctagtaacaaagacccccaactgccatgacaattaatcctgtggaaagctgagggtagagtgaacagaggaacggcaagatcccattggctgtatggtatgccgggtccctctgtggcactactgagagtcagacgggcccctgatatgctgcatactgaagagactacacacatgtatgaaacagcaggtggggtttagatattctctgatcaagttccttcacttgtttctctgacagaatccctggcctgtgccttaacaacatccacacattcatcttcccactacttcttgataatgagtttgaaaacttgccatggactgcacatagatctcactagagttcatggcggagctgcagccctcaacttcagccagcctttcattctgtttctcatcagatacatttaatggcaagtgggtgtttaaaccacagggaagggacagcaagaacaaatatataattagacatgtttcctggctgtgtgctttgtggataggcctgtaggttttctcctgggtgacttgccctaattgtatcatcagcttcccccagcagacaactgggctgagtttgatccatgaacttgaagcacgaggtgaagaatcgtgcatctacaagagcaattataattataattaagagtgggttggttttcttttcggtttgccttctcgtttttcagtgagcatggcagggatttccattaataataaagacattctagagatgtagaattaggaactggtcgactctggttaattggcatactattgtattcccataaattctgtctgggactgctgtgaatagatttaaagctactaggaagaaataaaatatacagccctttacaatgaagttgttttaagcttgaagcttttgtgtttttagtgactttgaagccggataagtattaacttgagtattttattgtggagaatgctaaagtaacggacatgataagagtttctggtggatattcataaactgcctttggatctgggagacagagagttttatgaaactgtgtaaaaatgtaaataacagtatggcacacatttactttctgccacctcttgggtagtccattctcctcatttcctctcagaaaaagcaagattatggacggtaaaaacccaactatatttataattgggatatgctaattgcagtattttaaagaagctaacacagctcaaaataaacagcattttcaatttacaaatagtgataacaaagattaaatggggattttctttggagcacaatttacagtggattttagtgaaagttgaaggagccaagtcagttcgtatgcagcttaaaagcatgttttaactggcgttgtcttcaggccacaggcccttcagtggtagaaagaacaccagaatggggtcagcaggtttattaactggaagtctttggacttaagttgctgaagatctctattagtttgcccatctttgaaatggagaagataatgtataattcacaaggctggtgataatattcatatgcagggtcaggactagggtgaggtaatcaaggtgcttgggatgcacagtttaaggaggcaggtctcagccgccaactctgtgcttgcatagccctcatattctgcaccccaggagcctccttcacctctctctagtcctagtgctgtaaaagaggtagccctattaccatgcctggatcatatggaggctcaaaataaaatgtttttctactgtttgtcctgtctgcctcatagatatcttttgaaaagtacatagggaaaaatagagaaatgtactcaatgcagtgctctacaaatgttagctgatactaaatcacaccaaatcactagtaaacccctgctacagttattagttgcaatggtgttctcatttgcaaagatacatgtgtgtgtatatacaaacaatagatattatggtcgtttgaagaatttcaatgaaaaatgtgtattactgtgttgagagtagccctttaaagtaggattgtattttttcctgaggacaaattataagctttgtgaaattagggatggtcttctcttgccttatttaatttgactgccagcccagcaccgtaagtatataggcaaattgtatcagaaaattagtagggttggaaaaataaatcagaactgaacattgttctagacttggatggcctttagctggcaactggtgctaactgctgggtgactggagacagcaatgggtatggcaagggtttctggtagatatacgtaagcctgccttttggatctaggagacggagagttttatgaaactttttaaaagtgaaaatgacagtatgacacaaattcactttctgccacctcttgggtagtccatctatctcattacaactccagcaaaagcaaaattattgatgataaaaatccaaccatttggacaattacaagttaaactggggaagatgcataagtaggcagctagagggactggtgttcttaccacccagaaactggatcatttgggagagaagcgcaacaaaaccagccatctatggcagtctctgacgaagccttaagcaccctttaaagagattctacaagaattgcctgactccatatgatttaaaagctaaatttattcagagaaaagaaagattttttgctgagggaaggacgttgctgtatgtttcatcacttgagtcgtggcagataatttgggttgagttcaaacacaatgtacttttcaaaatgtaaatctgtgaagaaaagctgaatttttagagccatcacagttttagaaattttatgctgtaatctgattttgtagtcaaggtcagtggctaaagaatgctgttggaagggcctagtctgggtcagacaaaggaccgatttggggaagatttggctgatgtcttcttttgtgcagggagagttattctctcactgggttttctgtgcaccagtagggaaagaagctgcacacacatggtatgtgtgtctgtgttactccaaaacccatcccaggctgtgctgcagtccttagtgaaacggagagattttgatgagtcaccaataactggtttcctgggactgatcatttaacatatacaagcgcactcagatttctgctgtggtttagaatagactggggggtgaaaacctgcccaggtctctgtttcatattgtgggaaatgtttgtcttcattctttctccatagagaggtggtttccatgatcgatggacagtctgaagtctagaataatggtaactatcatgttctgagcttgtgtagctatcatgttctctatcttgtgatgtgccaggccttattccaggtccttcatgtcgcaccagcctcgtgatctaggtgttctcttgtctttattttccagatctaggaactgcagcacagctaagttccatgatcaaggtagtaaatgtccctgctgtatgtacctcgcccgggctcacactcatcctgatgcagtaacttggaagtcctttgtctgtgtgcacattcatgtttgcttttgaagaacactgaagagattctactttgaacagaaaatatttacaccgaggtccttgttctctctgttgagtgctaaaagtgagggccaccaaggcaaagtgacaagtggtgccaggctctcagatttgatgcttctgcttggggtagatttgtgaggggatctccaactccagccctttcaggggccaaggcaggccacgtgaatgagtgaagcaggctgggcagagactccactaacttgctagtgtcccttggacacagctgcagacacttgttgccaggaaggattagccagggttgcctcatagtttaatttttctggagaagtcaagcattgagattaaaaaatttttgtaacaaatgttgagaattaattttaaaacttttttaaacagtacaaactaacccaaacatatctatgggccagatatagctaatgggctgtcatttctatataatttctgttctaggtgaatgatgcgtcacctacaaaaggctttggtttcttgatcttcctgttaggaggaaaaggagctatcacctataggaaatcccaggactggggaattgtataatagagggacttattttctgtgtagtgcctaggtatagccctgtacactttatctctctgcactataccgttccttgagcactagctacatgtagctattttaattaaaattaaagttaaataaaattaaaagttcaattacctacttttaccaaccacatttcaaggactcaatagtcacatgtggctggtggctaccatattggacagagcaaagtagaacatttctattgtcactgaggttctactgaatagtccaagtccaactctagattcttaggctctggcagcccaggctatcttacaactaaatgttctttctggtattggctcttcctggtattggccaacagttactgcgattgccccactggcttaagcttgtttgctttgcttaggtctttccattagtccaaaaatatctcagcattcggccatttccaggtgccttactgttggctcataaagatgtgtttggtgatgatgtttggtcaccaaagaagaaaggaactcttgttacctcttgcacttctccctcagactatttactgccattataatgttatatttgttgggaagtgaatgcttactctccactagaatcccactaagagccccaaggaaagggatcatgtgcttgccattttttcttcggttccctacagagttcctggcagagtggtcagccacaactgttggataaagttaagccctgggtaggataattttcctttacaacagtatgtccagtgtaggcaaaacatcattcccaacaagaaaaatggcacatctcaaaaaaagtaatttccatcatgtgttggcttataacgtgccatggtgagattcagaaccacaaggtccctgttcctttcacagtaatgaacccaaagcaattgaatgcagagctatcaacatgaataagggcaagtcaactaggactttcttatgcatccagcattaaagagtttttgttaacatccacagtaactagtgaaactttgtgtgaaaacattcacagtaactagtgaaactttgtgtgtttctgaggtcacattaaaaggcggtttgggtaggctaattatccttttatcatcctttttggtgttatgactattcaacctctttttatataaacttaaatatcctttgctcacacaatgatccagacagctggatactccttatagggtagtcaagagtattcagaggtccctcttcaacatctactggctgccatggctgagcatcacatccaatgtaaaaagctgaatattcttgggacaaattaatattgatggttagaaataataaaataaaaagatgttttatttttaacatctaataaaataaaaagatgtttttctttaagttttcaaaaagagaaaatagatttttctttatttcagaaaaggaaggatgtacggcattactgtaagctccacaaaggcaaggactatggttttggggattgtccttagaatgtctttccttcaggtccatctagtgagagtcttttaaaaaatatatcagatgctgtggcggacaccaaaccaattgtatccctcattcccttgctgtaagttagacaaaataagctagctggaccccaaatatctgatcttttgaaacaattagatgacaatgatggaatgatatataattaggaatcaccaaaaatagttcaggtataacataaatcctctagagagttgaagaaagatgagaatatttggggctaaactgatgaggcaaggctttatggaaaaagtgagaaaaattgacccaaagatgtgaataggtgagagagtggaagggaagtcattaacattggaggagagagaaaaaggagactgaatcctggtatgagccaagtagcaagaatgagtagacaggatatgtttatagaacagtaatgattctgatttgactttttactgagaaaaggtgggttgactgttttcagccaattatatatgagatgcagaagttggatctactaacttgatttagccagcaacacatagttagaaatgagtaaaaccatattgggcgtgtgggggctctgcctgtggtagttgacacttctttttttggccaggatggcttggttgatctgggcattaaaagaggatgcccttctttcctaaaagtgaccttcctagatagcaaatagaagataatgactactgtttagtcaatgaaagatgtgcagtccccaaataatcaatatttcctaggcacaattcatttatgttttgtttgtttcaaaattttgctagcaagtatctcaccacgtattggaaatgagaaagatatgaccatcttattttggtaacagttgtcgtgggtgaatgccaaaatattatgtaaaataaaacctttaagtatggggaagtaagctcactatctcagctttccctccccttgtctgagctcagagcatcaagctgttaaggactgtaccagtgactgcatgtgttccccagagaaaatgaaatgagcccaccagatatcagtaaatatttcttactgttttggtttccatgtgtcttaagtgtgaattttgagtaaaggttttattcaagcaaaaggctccttactcattttttctacaataatattactaaagtttagttaatggtattcaactatctgttctactcagcaacataatgtaatcttatgaaataagaaattatctgaaagggcatttcttttcacatggctttataaagcatccgtgttgaatgtttgatggagaaaatgagttaataacatgagaggtttatgcattaactatttaataaccagtggattcaggtaattctgtttctcctgctaccacccgaagtcacaccgctccccagattcctgatgtgttgcagccatttttctccctatatcataactacccagcactaccctgcaaatcctcagagactgcccataggccatctgatcatcagtgtaaggcttcagaatgatctgaggtccactactggcctctgcatttcttccttggagtccattcacacaatttagtaaatatctctccagtgtttctccaaaaggcaaaatccaaacactgatgtttggtgcacatgaggccaggaaagggatttgcgagctgctctagattctcatattttccaaatccctttttcttctccccttcagtgccttctgtctttttctccattttctccatagcacttatcaacacttgacaaactatatcctttgttcatttagcttgtttgttgcctaacaagttcccagtagaaagcaagtattataaagacaaggatttttgattattttatctgctgttatatctccagtacctagaataatgcctggcacacagttagtgttcaataaatatttgtagaaagactaatatagagcaatgtttctcaacctggggcaacttagccctccaggggtatttggcaacgtctggacacatttttttttatttgagacagagtcttgctctttgcccaggctggagtgcagtggcatgatcttggctcactgtaacctccacctcccgggctcaaacaattctcctgcctcagcctcctgagtagctgggactacaggcatgtgccaccacacccagctaatttttgtatttttagtagacatggggtttcaccatattggtcaggctcctcttgaactcctgacctgccttggcctcccaaagtgctggggttacaggcatgagccactgcgcctggcctggatgcttttttatcatgaggattgaagggataagcagtgctattggcttcctacaatgcacagaacagtctcttaccacaaaggattatctggctccaaatgctgaagttaggaagccctgatgtggagcacagaatccttgggagccctgccaagaaggctggctaccatctctcctgtggctctctggcttatctcctggactgtggctctttctgtctcatctcctgaccacacacttctgtttgcgttttttcatccagaaattaaaatatctcatttgttcctttgcagttatgtggtttttttttttttcagttcctttaccaccactactttaatgtagctttttgaagaagaagaagcaaatgcctgagcttagctgccatcttgaactcgaaactcttatcacttttatcttgtttgagtcaccatttctctgaagtctgtaatatgactgctaccaatacagcattctctcttctctgaattcttagaatacttaccatcagttttgaccatttgggtaatgtattagatagaattactgctctaacaaagacactcctaatgtaactattaatatatcttaaagaagatggaagtttatttctccccaatgtaacattctcaaattgggaggcctgagtcagtagtagacaccactgctccacgtgattgatcagattcaggctcctccaccttgctactctcccattcttgatcattgttctcagccaaaaggagaagagctggaagtagacagttcttgttctcagtttgagagaaaacgagaaagaaacagtcctgtttagcatttttcttctaaatatgtgctctgtgggatgcgtgtgtgtgtgtgtgcatgcctgtgtgtgtgtgtgtgtgtaagtgttaatatatttatttctggaagataggatcacaagatttgtaactttaattattttgctcctttatatttttccaattgtttttacattgaacctatactatatatatatttgtggctgacattagatattctttaactatttgttaaagaattactattaaattaaacgtctatgtaaagatcttcctttagaagggtaggaaataaccaagtggaggatagaggcttcttttagacaacaaagaactcaagcaactgtaaatacaagcaaaaaaatgtaaagccatgtttgtgattttaagtgaattgaaaaaaaaatctcttaaagtatatctttaaactgtaatagttacgtatatgttgtataacctttcaaaaaacaaatcaaatgaatcagatgtttgacacagtagaattaaaactcctaacttgactgatatccgccccccccacctttgaccgattatgttgacatttaacaaattaaagttaaatttaggagttgggagaaagaaagggaatatacaatgggaggtggacaaaacagtgtgggagagtggacacagaataagggccacggtgtgtattcagagaggtgacagacatcaacatatgttcatcagcaagtgacggaggtcaacaggtagaagaaatttgagtgaggacatgggacatttatcagcaaagacatgaaaataagacagtaaataaagcttgtatttgaaacagaaaaaattaagtggaagtaactgataataaacctgatttaattaggcctaaaaagttttatttgttacctgttagtcaccatattttaacccttctttggccatatgtagaattagctgctgtccctctaccaaccttaagagatatgaaagtggggaaatggaaactcatcccaagaggacagttgaggttcatttgatgaaggagacagaaagctttgggttaaagattaagtgatccctttgcaaattaattcttatactaaggtactgtgaacatgggtcagttttcaagggtttctttaggtttaataccataatactaagatttcagtagcatgattattgagcaacataaatagtgtatacatttttccaagctgtttttttaattaagatattatgggccaggcatggtggctcacgcctgtaatcccagcactttggtaggctgaggcgggcggatcacgaggttaggaaatcgagaccatcctggctaacacggtgaaaacccgtctctactaaaaatacaaaaaattagccgggcgtagtggcaggcgcctgtagtcccagctactcaggaggctgaggcaggagaatggcatgaacccgggagccgagattgcgccactgcactctatcctgggtgacagagtgagactccatctcacaaaaaaaaaaaaaaaaaaagatactatgaacatttttactttccatgtacgcgtataatgttttttctgattatgtaacagtctatggagtggaagttccaattaatatactcctgacaagattagcaaggttggctatcagatgtatatttattgaagaaaatatttatttgacaccacttattggtttattctttatccttagatactttttaatgaaacaaaatctttctacattttgattgtcataggtgacttatttaagttgaaaaaaataacttcgctttttttttttttttacaaattgctggagttgtacatcgatgagttaaagcttataattttaaatattaataattaagaatagagcaagtgctgctgccatttattcaaaaagaggcaagagatgttaaaatgaaatcgataaatgtatttgttgaaaattaccagaataaataggaaaaaaattttaatattttgaatgaaaaggctagaatatgacatattctaaatcccattgtattttacttctctgaaaattattttaagattatacatttctatataattatttttacaaaatatgatttaataacataaacaaaaataaaatataaacatgtattatttatgttaattttctctttattaatattttttcttctcctccagcttattattataaaaatcttcaaatatagaaaaattcaaaacatagaacagtaaacacctgtgtcacctctaagatttaacggctgttatattgtaggaaaataaaaacttatttgctgtatgaatatatgaagtactgaaatagaataaaaacatacaaagtagtataaacacacttttatttctgtaccacattattgatattgtattgatacattgttatatttttgaagaatcacaataaactctagattggagaaatactcactcatagactcaggccctggaaactaggagagtccagtgcaatcgtttttgttatgactcgttctcttttatttttctcctttctttttaaatcttctttgtctttctatctgacagaagaataaaatttagcaaaataattattcactaaagaaatatctaaatgaatattggttacataccaaagatcgaataattgcattctataatagggaagtctgttgtctttgtggttggttggtcttgtgttatacagttcatgaatacataaataaaattcgtgtgtcttttgcaaattactcttttattgtgttccttggaaataaatcactataactaacatgtattgagtactgaatgccttttttctttttgtaatagactggagtgaatttagttctgcatggtaagaacttagtatatgtagtaagtcaattttaacttactggtaagtgacattttaatgaaacatttttaaatgggcagatctagtgttgccagataagctgaagcatgctcagttagatttgaattcagatgtacaatgaataattaccttaatataaatgtgtcctaaatattgcataggacatacttatactaaaataattactcattgttcatctgaaattcagatataagtggatgttctgtattttgctttgctaaatctctcaaccctagcagaatgtgatatgttagatgtttggtcatctagggttttgtttcatatactttttttgtctttttattttatgccagaatcatgatttagacaaaatattttgcaagttttagctacctatctgaaatgttggaagcaaaccaatcaacaaacttggcaccgtcactgaggaagagagaaaagtgaggtatattaagttactcaaccatattttttattttatttttactcattgattataattttttctctaagtataccaattatataaactcaattataagaacaaacaagtgaaacaaaacaaaataaaccaaaaaataagcacacctaaaaaacacagaatgctacaaacacactacctcatattaaatgtattgccctccagaatcagcctctgttctctgaaaaacactgacctgggtcttaggaaatcttaccccccatcctggtgttgtccttatgagctctctggcatgagcaagtatcttagtctcctaggattctggttctcatctgtcaattaaagggtttgaaagattgatatctgaggtcatttccagacctgaggttagagtagcccatgatttcagcttcaagttcctggacaataattatgtatccatagcactcatgagccctgtacttgtttaattaatctgtgtttgcttgttttttaaactgcaccatttctatgtcttcattcttctttattgaaatggatttagttttcatcttaataggtgtaatgatgttattcatgcaaagcaataattcaaaattaaatccaaaggaaatcttttagcagtattcacattaagatgctggatgtgccctttaaataaagtcagcatttctccctaatgattttgaggctcattctaaaagtttaatgccagaataaaatggtattttccttgggaagaacaattttggtggtcccattgtagagcaatctttttaagagaattgcagaaggtaaaaagaaatgtacatagatcgtgataattttaggcattaggacagtgctacataagacagatgctttctaccgtaatttataaacatacgctttaggacatgtaatttttcccatttgtattacggggtactttaagtgtagttgtaatactttagagttatttcagacaacaaaaaaacccttagagatcatctatccaactttctgtctctgtctctgtcgctctctctctctctctctctctctctctctctctctctttttaagaagaaactcagtcccagtgcactaggtgactggtacaggggaaagtaacttagggaagaaaaggaagcatcctgtaggtactttgcaggcatagctgatgttgtatcataggcactctatgggctggcccagccccagaattcctgctataaaaggattgaaagtgatagtgtggtcctgggatggaggagggagggaacttgtctgagatgtgcctgggaggtagggtggagtgggagacttgtctggaagctaaatttgcatttcaagttcattatttttgctcaggttgtctaaatgtggtaccttgatgggagagccagggaagtggggaggagctgatggaaatcacagaggggctaaatgcttcccatgccacttcttggctatgacaccttagccaagatatttttttcccaactgtacagatgataaccctgaggctaaaaagcatttctttgatttgctgaaagttacagaataatgggtaggattcaaactcaggtctgtcaagccagaaaatctatatgtgtgatgcattataccatgctgatggaataaacatgacctcaacaactttgaaaccttccttgaaaagagacacaaaccttcaggaccatacgtgattgtgtttgctacatgtagacacacatccttctgaacatagtaattcaaattaaatttcttaaaagtcattgaaaaatgtatagctagagttatgtctctatgtgcaaattaattgctagaagaaagtaaaacataattaaaattgaatataaagcctattacattaaagtaatgaattatttattttaaaatatccacattgacccagttccattggttggttttaaaatagcaacatgtttttctcctgagaaaagcgtttctgtataaatacattcattctccctcccttacaggctctttcttgactgaacaaaagtaatttatgctttttttttcttacttagaagttttcataatcaaagggagtctctaaagcatgtaataggacggtagatatgaaggttgatagatatgtttcatcagtttcaagcacataaacagttcaacccccaatatacaaatgttataaccaacagtataatttttagcaattcatgtagatttgatgccagacctggctgcaaggtagtgtggagtaaacaaagcaaaggccctggagttctgagtttgtcagatcctcagtgtcattgctaactgcttaggctttaagcatcttgccaactctaaattctactctacattcttgccaactctaactgaattcagcttctgaattcaactcaaaattaaatttctaattaggattagaaaattctaaattctttgaccggatttataaaatcaaatataaaaaacatatatatatgtttttttgagacgggctctcactctgtcacgcaggctgaaatacagtggtgtggtcatggttcactgcagcctccaactcctggattcaagtgatccttctgtctcagcctaccaagtaactgggacaacaggcaggtgccactgtgctcagctaattttttaaaatttttgtagagatggggtcatgctatgttgcccagattagtcttgaacttgctttttaagcagtcctcccacctctgtctcccaaattgctgggattacaggcatgagccaccacatctggccaaatattgtatataatacatgtttctggtagttcccagggacaatgaaagccttttattcccacagcagtggttctcacaatgtggtccctagaccaatagcatcaatatcacctgggaacttgttagaaatgcagattctcagcctccatcctaaacttgctatatcagaaatcctgaggacaaggtcagcaacttcggttttaggaaattctccaggtgattgggaactaccgttttacactatgatattaaagggcgatttcaaagaatagggtaattcccagattattatactgagagcttcacaactcaatctctgccttgactgtatcacgaagaatccttaaacagaagagagtgagccacaatggatggttgtggaagtgaacaaccaaggcaggtggtactgccatttcctgatagaacactttccaatcccgcgtctcccacctctgggtttccatcttcctgtatctattttcataatgagtgttcatctaagcattccaaataagttcatactggataattatggatgagaaataaattggcaaccagaaaaataggaaatcatccctaaacaatgcctattgataaatatctggaaatttttctgggaagcataggtatgctgtttcacaatataagacatgaaagaatgttcccagaagggtaggagtggctggactgaaattgaagtagtaatttgaggtgtcacagtggacacctcaaggtcatggcattttatttattgttgcaattataagaacaataaaactgcaacaggcagcagggtccatgcagtttcaccagccttccacacgataccgttccccctcatcagcacttctgatttccagaggctcgaatccactaagcagcctcagcaagcacacacattaatatatttgcccaagacagaacagtttttgagctggcagttgttgataaagacatgtcacccctggttttgttctttactgaaaggcctccgaataggaatggtgaaattctttttatcacctccacatgggttgtcttcttggcacaaatgaagagaccggagcctgcaatcattcctcaactcctaaaacaaaggaaggtggattccattattctaagggccctggggattggacatcttcagaagcattcaagaaataaggaagctgcatgttaaaaggcctcagtgctgattaaaagtaggaacaaagctaggtgctcttgcatttatcacatgtattaattgtactgctatctttggcttgcagaataggatgttataaagaatgcagtgaccattttggcatgttgaaaatcccattattcatatgattaagaaacaaaagtgaagtcgccaagcactgggttatgcccatctaaagatttgttgatggaatgaaatttatcttttattcatactccaacaacttctgaataataatttctagtgctgctcttcggtgcgtttctggtggttctgagctttattatgatcgtttccatcctaagatatacttctctttttagtatttttataaaatttgataaaaagaaaccagtggaagtgatcatgtcacctcttgtttataatgcttaagtggagttttctttgtatagtcagcaaaggatggataatctcactactgcttgttcctgcaacctcagtgcatgctgttcaccccttgccctctgagttctgaactgactaccctcctctgagatgctcaaaggccactgatatggtttggccatgtccccacccaaatctcatcttgaattttagctcccataattctcacatattgtaggagggacccagtcggacataattgaatcctgggggtggtttccatcatactattcttgtggtagtgaataagtctcacgagatctgatggttttataagattaaacccctttttgcgtagctctcattttctcttatctgccaccaagtaatatgtgccttttgccttctgtcatggttgtgaagcctccccagccatgtggaattgtgagtccattaaatctctttttctttataaattacccagtcttgggtatgtctctatcagcagcatgaaaatgggctaatacagccccaagctcctttccactcatcattttgcacatgttgattagtcaccagggatagtctttcactttgcctgggaaatcccactcatcttttttttttttttttttttttttgagagggagtgtcactctgttgcccaggctggggtgcaatgacaccatctcagctcactgcaacctccacctcccaggttcaagcaattcttgtgcctcagtctcccaaatagcagggactacaggtgcacactaccatgcctggctaatttttgtatttttaatagagacagggtttcaccatgttggccaggctagtctcaaactcctgacctcaagtgatatgcccaccttggcctcccaaagtgctgggattacaggcatgagccaccatgccaggccccacttacccttcttctcacaactcttacaaatctcattctggagagcctgcctctggctcccatgctagatcacgaccccagtcatatgctttcaaggcatcttagagttttgccttagagtaattatttgattaatgcctgtctcccaacatagaggccataattttttcatcattttatccctagcacttagtagagtgccagcctggcatattgtgggcaataatagccatcaaatgttttgagcagggaataatatggttggatatgtcttagaaaaataacccttgtaagtttggaggtcaaattggggagtggaacgattaataatagagacttcttatagggaactattgcagttttccacgaaggaaaaagaaaaacaacttaaaaaaactacctaaactatcaattttatcatccattcacccatttgctgaacatttactgagtgcctacaatgtacatgtcagatactgggctgggtgctgagacaataaaggactctatttggaaaatgaaaggaaggggatagattttaaaggggtctaggggtagaatcaataggacccactaaacaatttgagatgtaaaagacgggcttcaaaaggaatctaagatttcttgctcaatgaccaaatagagggtgattctattaacccctttttagaacttcaggaagagtagcaagtcagaacaaaaggtggagagctcaagttgaacatgtggagtttgagatgctcatcagatttccagatgaatcaactggttcaatcacagtttttgaaatgaagcatcattgttcagtgcaaatcttccaggggaattcaaatgttagatacagagaagtagagactgagaagagagcaaggcccatttaaaaatataaaagtttagttttaaaaatgctgtctttttgacctttacaatgtgcatattttgaatgagagtaagcaaaaacaattgatttttttgtaaagaaatgctgaagaaatacattcatcaatactgtagtttgaatataaagaaaatcagaatatttataaataggaatataaataatatagcactcttattggatagcaatggattaaatgggtatttgctactctactgcttttttttgagctgattataattatatgaaatatattttagggcatgcaattataactgtatgggcatacctaataaataatatgtctatatcgcataaagtataaattataaatatatatgaactatataaaaatatactttagtcacttaaaacacataatagaacattttattctgttttttcatctttttttctgagtacgtaactcttgcacttgtccctttcaggcaatgcttaagaatgtatgtaaccaacaaatacaatgataaatgtcttttgcagcaagcttcaaaatctcaagagatgtaggggcagcataaaactctaaccagataaatccatggtatattgtctgagccaaatgctttctctaaaatgagagagattcaaatcagtgacaagaaggagcatgtggggcttaagctgactgtaggaggacacaggtgtgcttcagcaccacaaatgaacgcagaattatctaagaacaccttgccttgccagctatttaatatcacatgaaacgggccaagaatgcagtgatattgaaacaccaatgccagtattgtttttcctgtgtctattccagcaattgcttctttgttattgttgttcaatgaggtgttatttcaatactgaagtagaattcattaaagtaaggtttgagtggagatattttcactggttgattggttaaactgaggtttctttttgcctctctagttatccagtgtattgacagccatattttaacaagaaaaaaattttgacttcacacattcactcagtaaataactacttagaaggttcttgagccgggcacggtggctcatgcctgttatcccagcactttgggaggccaaggcaggtggatcatgaggtcaggagatcgagaccatcctggctaacacggtgaaactctgtctctactaaaaaatacaaaaaattagccaggcatggtggcaggcgcctgtagtcccagctacttgggagactgaggcaggagaatggcgtgaacccgggaggcggagcttgaagtgagccaagatcgtgccactgcactccagcctgggcgacagagcgagactccatctcaaaaaacaaagaaggtacttgatggacaacactctctagacttaggtagagcgataaagtgatgaccaacttacagctgaaggggaattccacatgttgggcatagagaagagtaggtaaaggtatagggatgacagagaccatggttgctcagataatgacaaacagctgagcatggctgggtgcatgaactaaaatattgcttgaatgtggggaagtaggatggtgggttgcataactggtaaggagcaaaccgtgactagccttaaatgtcaatctacagagttaagatttccaaattcattaggacatgtatcctacagtgtgcaaggatttttactaaaggaatgacatggccagatttgccatttggaaagctgaccccggccatcgtgtggaggatagtttggatggtgaggcaaggaatcagaagagaaggaagtgtggccaaggaagagactcttgtagcaattcaaatgagaatactgaacactgaaccaaggacaagactttgaatgtggaagcaggggaaccacataagacaaatctcaaacttggatgctggggatgaaggataagggaaaatcccaggtcaattgggttgatggagtgtatattggtttgctaaggcttctgtaacaaagtgcacaaattgagcagcttaaacaatagaaacaatagaaatgtactgcctcacagtactggaggctggcagtctaaactcaaggtatcggcagggttccttctttttgagggctgtgagaatagagtcggttccatcactttctcctgacttctggcagtttgttgacagtctttcatatcccttcgttctagaagcatcagcccaatctcctgccttcatcttcactgtgagttctccctgtgtgcacatctgtatccaaatttctccttttctagagatgccgttcatattggactagaggcccaccttactgtatcatgacttcatcataagtaattacatcagtggtgagaccctatttgcaaatcaggtcacattctgaggtactgtggtttaggtcttcaaggcagggatttttagagatacaattcaatccacaacagggtactactcgtggaaacagagaatacacaaagataaaccagtgtttgtgggaggaaattattaatgcatcattggttatgctgagtttgaggtactaagggttcatgcaaatagcaaatatttctgggactggacttaaacaattctagaacatagaaaccagcatctctcaaaaaagagaggccttgggtacactgcctactataatctcttttatttgtcttttttgaatttaaaaagtatttaaattatattagcagaggaacagaaatttagatattgcctggaaattttaaaaatcagaaggaaagggccaagtagaaaaaataggagactcttcccagatgaatttcaacagcttggtattcgtgtgatgagttgtgattaacaggcaagcaggccaaacgtggttaatagagctgggtctttgagttttctttagaaaatgttgattctataatataagtgacacatctccatacgccccaaagcagcatctggtttgatattgaggtttcacctaacagttttcttcagaaaactggaacatttggccaatttcttaatatattaattttaatagattttctgtttctaatgaaaacattcttgtgaaaacatttgtttttcatatgcataactccttattgcccaatatacataggaccttatatatggtagatgctaaatacatccagttgctggatgactgttgtgtaaatgtttgggacacaacctttgaaaagaatctcaatagcccataactccatgtagcatacaggcgctcatataatgctctcccttccccactacaccacatgggaatgttatggttgctaagaagcacaaatgatgccaccaaataagtctaacttgggtgccaagtctgttcttccagtggtatgggcactatctttaggcagaggcatccagtaacagttggaaagaaacccgtgtgactgcgacctgtacaatgcatgcaggtgacagtcttctctgtgcctctaaatgtgacaggcatcttggggttatacaaaaaaaagtatatcagatagtgccttctatggagacagtcaaaagctaagattgttggagtcagatcgacatcttcatatcccagctcagccagctctcgggctgtgtgaccctgagtgagtcaggagctttctcaggttcaacttctttataatgtggaaattgtaataacattaccttttagggttattgtgagcacaatgattgtatagagattaaggcacataaagaagttcacaatagtagatatggttgtcaaaattatcatcataattataccagagacctgaggttcctgtgtacttcatgaatctattaagaaaccattccagaaagtaggaccagtgggagatgaccataatagccatcgatattgcaaatggagaggggcaaatatgggtgcttctgtgatctgggaggggccttggaaggaggtaaggcttcagtggccttcaaagatagagtcttaaaagaagattgaaaggacagaataaaaatgtactgtctgaactccactatttcaaacacttgactgatctttgacttctctgaaacctgttccttaacacaatttctgaagaaggattggttctcacaatatttactattgtaagcttcatcaaacagccaagtgatttctttaaaaataggggttttgacctttgcctttccctggctgggaacttaatcatcattctttggccataataggccaactctatttgtgggcctaggacttgatattggagatcacgtgacatccttgtccacgtcctacgcagcacaacttgtcaaaccagagcagatggctcttccgagtctaccccactggcagagggtgaggacgtgggaaatgaagaggtcctttacagcctgggcttctgggttgctatgcctgtcaagcagcaaattatgataaaaagggccatgcaaaatttaacatttttttaatctcttgagaactgactacaatgtttactcttttctggagcttcccggaatgttttatataaaacttttgctactaaaatcctttggagttttagaatgatgatgggaagtatagcagagtttaagttttggtttgagtccactaaaccaggttcaaatgtatcagttgtgtgtccctgagcatgttacttaacttttctaagtgtcagtttcctcatctgttcaagaggaatggataataaggccctactcgtaagattatagtgaatattaaggatacagttgtatactgcaaaaggcttttgatacatgatagaataggccctcaataaactctagttattgttattttaatggtgccacacacaggtgatcaaggtttcagtgccacaaccattgaaagcttggagtcccaatgccagtaatgtcatttttaaattttcaagtcatgacagcagaatggtgagatgttctgctacagagaatagaaacttttagaaatggtttccttccaagcaatgaggtaaacctcctcttaaaaaaaaaaaaaatcttagttttccattgttacaatttcaagcagtggcttaaaacagtaagcacttgcaaattatgtggctaaacacagtaggcactttttggcatgtgaatctatgggactatagttcaggccaaatggctctgctagcctcagctgtgtctggaagtcagctggtcattgactgactaaggctaggtctggccaggccaactatatttgtttcacctgtcttttatccgtttccctgggacaagccagcctgcctggacatgttcttctcatggtagaggtataagatagagcaagtccccaaagcaatcacccaaatgctttgctagactgcttacatcacatctgctagcatctcattggccaaagcaagtcacatggctgagcacagcatcaaggggcaggggaggtgactctcacactgtggggaagtacagtaaagtccctgagggaaaggatgtggatacagagtcggggaagaagagggagcatcatgtgatctacctcagctttagagtaaccgatagccaaggggccatcacctcacagcgtctagactctgggaaacagacttttgccctagtattgattctttgcctggagtcgtatcatttgctttagtacctggctatggcgttaataataatagcacagcagaaaggttcagtgattcttgtatagctacagactgagctttataaaataacctggatgcttattttaagaatatagactctgacagtagcaagaatttttctcaattgttttgaaaaggttctcacctattgaacagctaggatgaggagggttgattagaattttcagtgcatgctctgaattatgccatggagacatgtgcaagactaatttgtttgtagcaacagagaagccaatcatgattagatttcctggcatgttattcacctgcgaggagagtcagacttgtgtccaagaatctcaatgtgaatttggtcataactacatccatacagtgctggagggtttgataagctctaggtgtccaagcatgctcttctagaacttaactgacttctgcatgcacgccagccttcctagtgtaacttagggcagagctatgttttacttagttgctattgtctttgtattttatttaattattattaggtaaataacagctatctggaagtgaaaaagtcaaccatgatggctgatttttagagaaaatatatcttgcttttaccctctgacttctagcccttcagttccttggggaaatacttgaactcactgagcagcggtggggtcacagtctgggcttgtatgccctcatttccaggccgcattcctcagaggggccctgagtactttgggagctgatagagtttggctgtcatttgaaaatgttttcctgctaaatgttttcatttagaagctaatttatactctgctttcaagtaagcttaactccatttcacatccctgacatgtagcacacactgcagtgactgggatggaagtagacaattcaatcaaaggatgatttctccgtggaggaaatgaatattatttgttcatcttgcaattcagaattctgagaaaattatgatgtttggcaaaggcactggcaagacagaaagacaaataaattgcatggtgtgagaacagccttcttaatatgaaggtttccttaaaacagtgggtattggctgcaggcaaaatattaagctgcaaatcactggtttgcaacttcttgatcatcggttgtaatcccaagaacatatttaatttcatatttagtcctaatttctttttgttccgtaatgatatttctgtcactcaaaataagccatctgttggcagcagcccacaggaaacagatactgcacactcagtaatcttggagtgagtctgttgcattgtgagaatgaaaaacgggcctcttcagaatcatagggtcacctttaaaattcctaatttttctttttgtcttctctttggccatatgtagtagtggaaataaatcttgtttcattgtcttttctgagatgtttgtgaccagaggtcagtgctttggactcgaggattagagagtttccagctctgcttggagatgcatttcccatttttttaaccctctatttaatcaatacctagctttgccatattttcaagaaaaaatatacctggaagtattgaccagaaatcaagcctatggcaaaagaatgccttccatttgaaggttatgagatggagggcaggatgtaagacagggagcaccatgatgtgaggagtgggcagaatttgataaattgacattatctccatctagtctttgaccacgcgtatttgaacagaattccaaatggaaagaagagacagctgggcacgatggctcatgcctgtcatcccagcactttgggaggacaaggtggatcacctgaggtcaggagttcaagaccagcccgaccaacatggtgaaaccccgtctaaaaatacaaaattagccaagcgtggtgatgcatgcctgcaatctcagctacttgggaggctgaggcaggagaattgcttgaacctgggaagcggaggttgcagtgaaccgagattgcaccattgcactccagcctgggcaacaagagcaaaactccatctcaaaaaaaagagactctgaccatgacttcacatgatagctaacacttcttgaacgtctgcagagactgtgctaaatgactgtaaatggattttctcctttattcctctcaacaaccccagcaagtttctcataatattatttgcattgtaaggatgagaaaacagtctcagagctccatagctattaagtgatagaatcttgatgtgacagccagggcagcttgatttcaagatatctcaatactgaagttaaaacttggaatgggttaaaaatgaagttgttctatccatcatgcctgcagaaaacctcctaagaataaagaaaataattcagattcacataaaagaaaatgttagagatattgaaatggacactcaaagcacatcaatgcaaaggtgagggagacagaggagcttttgatcttcccttttgttccctcatgttttgaaacatgcttccttttgatgccagctctttagaggttgctgcactcaagctttagatgactcttctatctcccagagcaattaaaaggtaatgtcactattttaccacgtgacgcttgacatctgattcatatatcactcagcctgaaggcatatttttcatactcacttgggtgcatgtcaagcagtgaattgatctcttttaggattcaaaaggaatccccttttccaaaggagattctggtgagtgaacaaaatgaatgtccctattacttcccatctcctttaattagcaagccagagagctaacaattatctcacctgtcagctctcttgacagcttgctgttgaatcggaaccaaagagagatcacctgccccaatttcaaaccccagcaattgatatcaaagtctccaccacccaaggtctacttaaagcccattagtgtggccttcactatatttcagtttcagttacctcaaaccaatatctcagattattcctccttccatcatggatattctgactcataaatgtcagtacatggtggaggttgcctcatctcacaaatttccactgtcaaaatattctcagcagtactagacagatggaaccaatccagggagcaaaacaaatgctaccccagcttttggcgcactccaaatgtagcggtactagctgttcttatctcataatatgcctatcgccatcattttttcccctaacaatctgtccatgatgacaagttctattccatgttcttgatgagggatcatgtctctaagccatatgttgtaactggaagactagcccagttgttgcctttacgtttttaaataagtggaataataccgctcatattaccttccattatcttagtacttatctcagtctggttctgtatcctcatcatttccctgactgagaaaactaaagaataatgtgtaatgtgatcgcaaatttgtaagatggaataaagcatttagtcgttctcctctgccaaattttttgattcccattttcagaggatgatttgtctcctgccataagtggacatggtgccactgagcatgtagcaggaccgagcagctggccaagacagatggattcctgtgttgatctagtgaagtttcacctttgtaaatcttccttgctttctcatgcctattaagcgatcttcatctcagaacagcctctttgccctggttttaccctctctagtaattgtgtctcagtgaactgtggttttagtacaagtaccctatgaaagatgtttgcaactctggtcatagttgggaagtcaccacatactatgctttggattcatccaaataacccttctctcattgccatctatctatatccatttacttatccatccctatccccctcccttcctccatccattcatccatccaccatccatctgtccacctatctggtcatttaatatttcttttggaaacagttttggaacttagctttaccttgtgatctgattatatgaaattaatctagccttttctgatttatctaggaaagaccttctttttcagagttctaattaagggtttgaaatgccacagttaaaacatagtgattttaaaacatatcataaattctctaacactcctccctttgagaggaggagtctgtgttccctccccttgaatcggggccaaacttagagatgtgcttttttttgttttgttttgttttttgagatggaatctcactctgtcaccccaggctggagtgcagtggcgcactctcggctcactgcaacctccaccccaagggttcaagcgattcttctgcctcagcttcccgagtacctgggatttcaggcacctgccaccacgcctggctaatttttgtatttttagtagagatggggttttatcatcttggccaggctggtcctgaactcctgaccttgtgatccacccaccttggcctcccaaagtgctgggattacaggtgtgagccactgcacccggccagtgatgtgctttttactaatagaattaagcagaagtagggctatgaaattccaagctaggtcagtaaaggccatactatccttggttctcatgagttaccttccttgggggaagtcagccaccatgtaaaacgttatactactctgagaccaccatgcaggagaagagatacatagactctctgaccaactgtccagctgagctcccagccaatagccagcatcaactctcagtccgggatgtgagccatcttggacatccagatcagtcaagcctcaaaggatttcagctccagctgacttcttacttcatcctcatgagaaaccccaggcaaaaactgcccagtcaagcccttcagactacaactgggccctgaatccatcatcctcaaaattgtaagatagtaagatagttgttgtaactgctaagttttgggttaatttgttatgcagcaataatagcagaaataaaaacaatatatgactgagttacttagcacttcaagggaaagcctaccattttgttttatagaaatgggctaattcttcttctagttttcacctttctgttttaaactatagcttgtcttgcaagctttgctgctagagattgaggtagaaatggatctagaaactatggctgtatgtcaatttcatttcctcaaaggatcatatattttatgcagatatggagagaatatctaagctgcaagagtttggaggtgaatagaagaaaaatagaagattttgtaggttatccacatcaatctatatactcctagtttaggttctcatattgtgttatataccaaatgtatacatctcttgatgactggatactttgtgaggccttctgttagtctttggataatgtataattcaacacagacagaggttttattttgacccttaagtctcacctccagggagggaagagaagccttcacattgctgtcacaattctccagatggtcctaaaaggagctcacttttcttgtctgccccagtcccagtcgtcatatcctataatcgaagcagcttcctcttgcatcttcctaaattaccacttagcatattccctgactgtgggcatattcagtcagggaacatgttaactcaaaccaaatattgtctgtgcattttctatctatgtgcatatcaaccttttttttttcagcgctatctgaacattaagcattaagtttgcgacattgctgcttcattccaaatgcgacatatataccctaagaaaaaggacattttcttatataagcacaagagcagtatcatactcaagaaacttggcattaatacagtaatatatctaacattcagtttatattcagatttccccagttgacccaatgatgttttctggttttgtttttgttaatagagtatctttattaatacagtatctaatgcatcacatttacttgtcagatctctttatcatcctgtaatctagaaaagtttctccatctattttggagtggtgtttggtaaaattaacatttttagagaattcatacccactgttttattatttaaaataagaaatatttaaataaatatttaaaataagaaatatttaaataaatatttaaaataagaaatatttaaataaatatttaaaataagaaatatttattattcagataaaaatgtgtcttattatttcttcctgattaaattcagattatgaatttggggtaggaatatttatagatgatattattcctttccagtatatcccatcaggagatacttatcatcagttagtcccattatttgtaattaaaagtttgattccgttaccaggatggtgtcctccatattttttattgtatcacttttttattccatattttttcattttaatagtttatgagcaatcaagaagtgacactctgacactgtgcaaatattcagttccccaaccagttttcatactatggttttcacatccactgatgagtctcacctgagtcaaccattatattgatggctgcaaactgatgaccttctaatcctgttccctgccggggtagcacaacaggcactgggctaaatgattgtacatggattttctcctttattcctctcaacaaccccagcaatttctcataatattatttgcattgtaaggatgagaaaacagtctcagagctccatagctattaaatatcagaatcttgatgtgacagccagggcagcttgatttcaaggtatctcaatactgaagtgaaaatttggaatgggttaaaaatgaagctgttttatccagcgtgcctgcagaaaacctcttaagaataaagaaaataattcagattcacttaaaagaaagtgttagagatactgaaatgtcctatgtccccattccatgtgggtgtagggaaggagataggcaatgtgaagccagggagggctgtggaggttcagctgctccatttataggctttcaacagatcgccctgttttcagccctaagccttacccctttgcttagggctactgggtatctccacttcagaatcctctacagagttccctggcaacagtcaacacactctgactacttctcagcaggctctcctatttcagttcttcttccttactatctgttatctctcatttaatatttaaaaaaaaaaaaaaactacatctcttgtcttttgtcacctcgtttttcattctctttgtgggcttttatttatttatttatcatattattattttaccataactttagtggactttcagaagggaccgaagagaaaaaacatgtactaaaacatgtgctcacgttttgtgtatgttggtatttttattcttcagttttacagatgcgtgccttacatttctactcacatcatgttgtttcatgtagcagaatattttcaggctgggcgcggtggctcacgcctgtaatctcaacactttgggaggccaaggcgggtgcatcaggagttagagaccagcctgggcaacatggcggaaccccgtctctacaaaaaataaaaacttagccggatgtgatggtgtgggcctgtggtcccagctgctttggaggctgaggcaggaggattagttgagcctgaggaggtcaaggctgcagtgagcggaactagcatccctgcactccagcctggcagacagagtgagaccctgcctcaaaaaaaaaaaaaaaaaagaatattttatttctgtgtaaacagattattattccttttttatttatgataattatataagcacttattactttcatataaggagaaaatcttcttcaaatttttatatgcatacatttttttcttcaaggaaatctatgattaagcctcttttataaaaaggtatgctttatgaattaattagagctagggaagttaggtaagtatatggagtaggaacacatgttttcctcccctcctcataggtttctagaagttcttctcttttttggaagacagaggaattatcactgccttgccagaagtagcatctgggcctttggtgtattcttcagcttgtttattgacagcttgtaaacgtgcatagatgttcacagtctttctttagttttcttgaccattctgaaatctttaaatgatcttttcctgtccatggcccttttagtcatcaccaaactagatctggtcctcagagaatcctgatttcttgaaaatctctcattattccgcaatactccaatctgctattaagtgaatactagaaacaaagtggtaggcactcaggatgttaggttttggggtgtttttgtttttaatgctgtatgtgaaggtgtgcatggcagttgataaggatgcctactctgtttcccttggcccagctgagtttacctgcagccttcatggacagttcccagataacacagacagcttccatgtcaaaaacctccatctcccactcctttcctggggacttctacagtgccatggtagttttactcagttctggtgaatagcagcctagaagtgacaagaatttaatgcctccaagggcatcccttaatcaatatgggagaagattcactgaataaataatctggtatctcagtccctcattggcactgttttaagaatgtcctatatgagtcctcagaaaaaatctgagcctcagttgcctacatgggttaccctctcgttaaaactcctcttattggatttctcccttctcagttgcctttcctatcacctcccctgttcttcctgggatcatcccaaataaactaactgaatccaagtctttgtctcagggtctgcttttgagggaactcaaactaagacaattacaaagactaaaaatttccagagaaagtgtaattatatgttgttggaaatttactctgctgaggggaagtgcacaggaaattattctttttagatctattaacaggcaactggtaaatttatgttataaataacatggtaatttactcaaaaatttctggaacccctactaggtgccaggctttctgctagggactgagaacacacgagtcgacaaaataaacataacccatccctctccatcatagagcttagattctaatggtgatatggacaaatcatgtcaattataattcagattggggcatgctatgctagaggaagtcccattactgcaggaatacatagggtcagaaagactgtgttcacccctgtttctcaacatctagcacaaaacctggcatatgatgggtatttgtttgtttatttgttcgagatagagtctcactctgtcacccaggctggaatgcagtggtggtgatagctcactgcaacctctgcctctggggcttgagcgatctcctacctcagcctcccaagtagctgggactacaggcacacaccaccatgcccagctaatttttgtaatttttagtagagttggggttccaccatgttgcccaggccagtcctgaactcctaagatcaagcgatccacctgcctcagcctcccaaaattccaggattacaggcatgctgggcacattgtggacgtgcccggccaccttgggtattttggaagtatttattgagtaaaagaagcatattcaagaatgagtttatattcaaagaattgcaaaaaaagatcaatgtcctacagaataaagcagatagaggcacggacaagaatcaggacttgtaggccgttgaatactgtttaggcctggagacttcatctgaagagttacagcagacaagaagcagagaaattttaggcattaggacagattcagtttagcagtttcacatggccactctgcagacactaggaagaatggatcaaagccagcaaaacagggatcagaaaaataagggagagggctatgctgtaatccacatgagaaataatggcaagaatggcaatggagatgtggaggcatggctggactggaaagagatgtaggagttagaatagatgaggcttagtacttatttggtatgagaagtggcatagagagagacagtgctaatattgcccacagttctgatcagcacagctaaatctggggctataggaggaagagtaaatctaatggtgaaggtgaagagagaggaatttgctccggtatagtgcttaaagaaggaaggcagttttggcagagttgttttgtattacatttctctctgcccacaaaggactctttatttatcaaaaagataaatctaaaatatgtcacttgaatatagctagataatttatagccttgtaaatctgaatggacttcaccttagataaaaacttggtatgttaacttttccatcaaataagtttcatatttttggctttagaacctatacatcatggtagtcctatttggccaaaaaaaaaaaaaaagaaatatcaaattatataatattcattttcttaaacaaaacatggttatataacttgtatgcttaggactattgtttgttggaatgatttaatgaactagattatggccctttaggtgcagtttattatttttaaatttcttcttttggaaatgtgaggaagggtaggaaggttaaatggaactgaagtagcaagctgggccatttaaggagggcatgagtttaaattctgaacgctgaataaaaatgtcctaaaataccttcatttggaaggaaatgactttagctgtttagccttggagggaataaacagctacatgcatactaatcttctgaaccctgtgctatgttcatagccttatcttttattcatttcaaaccatacaaatctttaagggagagaaacccctgcttcttgcagcattgcaactaaaatgcagatgctacatttctatcagtggaatttgagttattcttgattttataccttaggatatagcaaatctctaaagacagagtgtaaaggggtatgagtgtgtctattaatgggggaagaaggagtgtgtgaaggggatcccagtgggtgggtgaggagggagtgagaggcggccaggggtggaagcttacacaagagccaactgcagccctgtggtagagaagccctcctattctctgatatctatttcccaatcagaataatgaccaattccagtccctcttttggaatagggatgtggagagtcataatgggatttgaaagctgtcctgcttgtagactatcatttgaacttgacattttcacttgagtgccttcttcttgcaactagtttacggttttatcaatacagtttaatacacttttaaagccatacttctggcatgatctagcattttccaggaaaataaaagaggcacatactgtaactgttgatcatggggagtgatggatgggttctgccctctgctagtgcaaaacatatcactgaaagtctagaggaacaggtaaggggttgatagttgggacaatgaattttgaaagatactctgagcttatctcatttatctaaaaaatgacattagaaataaccagcacaacacggtgaaaccccatctctactaaaatacaaaaaattagctaggcacctgtagtcccagctactcgggaggctgaggcaggagaattgcttgaacctggaaggcggaggttgcagtgagccaagattgcgccactgcactccagcctgggtgacagactgagactccatctcaaaaaaaaaaaaaaaaaaaaaaaaaaggaaaagaaaagaaaaggaaagaaccataaattaactgggattgaaagtgtgtgtgacatttatatcatggcataatctccaaatgaagaacatgtttatttgatttggggatagcttactcaggattcgttgcctgatctttatttctctcaggtcctaaatgggactctttggaactcatgcattcctgacttattcagacctgcttctgaaccatgcttggctcagtaaagcagagaggcttagagaaggaaaattaaaatgggtcatatgcatctgtgtcctctttgaggcatgtcacaaaaacagccattctgggaacactgtaaacagttttacccatctgtctagtttaatctatttggggattaaaccttctggcttctcagagtacagggttgtgtgagaggctcgttcatttatgatatgtgtttctggaatgctggttacaccaatataaatgatggatttagggcactgtgtttacttaaagaatcatggatctcttgatttatactaagacatctggttttttttttcccaaaatctttgcttaaactgaagctgtttatccactgataaaataacctctgtgtattcatggtgcccagttgttggtaactagcaattatatactactttctaaaatagttttggttaaatggcatgcatgatttgtagtaatgaagttcttcaatgataaaaatattggaagagacccatttgaattttagctcttatatgttacaatgtacttcacactggctgtgtgcttagtattcatgttttagaaaataagaaaagcatttgggagatattaccaaaaagaatcactgcctctgtttctgtttatcctgtgattacagttttcttattaagaacaaatgtgggtataaactcaatacattgtgggattcctctctggtcaatggaccctcactgtgttctgacttctctctctttcttgattgatggtaatttgctacagtgaacttgaatccagacttcagtgtaagattgatgtgtgttaggaaaaagggaagaactcttgcccttagaatcagtttccaactttatttactgtttggggctttttccatgaatttcaattttacctatctaggacccatattagcttgaccattgcaagtagggagggctccaatcagtcatacagccatggattgatgagtcatacaatcataattaaagaggaattggcagcaacataaaattcatatgcaaataattgtgctgattcatcattgcagtaaaattcacttctctgcatttcttcattcaaaaagccacattcaacggggcactccattttaagtaggcaaatttggagattccttaaaaaaaaaaaaaaaatgttttccttaggaacaattctgtttagtaaaatttagcccaggctataaaatacaggctaggacaagatacgggttaggacctctactttctcttcattctttgattaggtagttttacagttcctgattctattacttagatataacatgtagaagaatatctacacttcagatgcagagagagaaaaaaataaaaggggtaccccacaagaagaaacagcaaacacacacaccaaagacaagaaatgtaagcataatcttttgttttttcccctgacacacagatttagcaagcttaccattggccccttgggtcatccccaaaccagagctttaaaaatctgtggttacctgagaccctagagctaagtcagacattctaggacctaagccaaagggccaatagaaactttagcccaagtaatggtcacacatgtttactatagagagcaaactgaattggtctcagagtttatctttctgaactcatgatggaacacagagagtacagaagggggaattgggcttaatttggtgcagctgttagaatatcccctggtctctgagctatttgtttgtcttactgaactccagcagattaccattgtcgggcaatctggcacattttgctcctttgttcatccccagccatgttatgtaggagtcatcaacttccccctcataaagacgaccactcagaaagcactttcaactgggacaaactcacatagtaataatctaatgtgtggctactatatgttaggcactgtaatacgctttactcaaatctcaatcaatctctacccaattctatgtggtaagcataactaagatataaaaagatgacaagagtcagaaatcaggtaagacactcagggtttctctactatcgtgtcaatggaaattcattagatcctggcccaaagcaatcaagcccatcttgggctgcccgtgtactttggctctagccagactatgagcacttcaccaccactaaagacctcagtggccattccattctgattatcctgctgacttcttgcctactgtgctctcttcaggaccactctgccccagctgccaaactttcaatctgtggcctgagccaccccagcaccttccctcctgcactgaaatcctcaggcatttctattaggttgttgcaaaagtaatagcgggttttgctattactttcaatggcaaaaaacacaattacttttgcaccaacctaatgctttgtcccacactggcctgcagagaacagcctctaaaacacttgccaaaggtgctggggttcccccaacccacatcttggtgaaggggctcattttggctacattgaaacgtggtttcatatgtttcatatgaaaccagtgtgttattatttttccccctttcccttatcttttagtggcctcaccagaatttgaaaagttatattcctttgataacataactcttcctcccattggctgagctcaagaagtgttggttaggaaagaaaacttcaggcagcccactgaattctaactctgtgtctgaaattctttcctacattaaaaatgttactgaagccctgatagtatcatttctttgatatgtgtatatgtatttcttataaagaaaagattagtttaagtgactatcaaaattaaacattttgttgaattattgcaaaactctgactgaaccatttagttatgctactaggatcacattttcctttttgtataatgcattaaagattctcactttgggaggccgagacgggcggatcacgaggtcaggagatcgagaccatcctagctaacatggtgaaaccccgtctctactaaaaatacaaaaattagctgggcatggtggcgcacgcctgtagtcccagctacacgggaggctgaggcaggagaatggcgtgaacccgggaggtggagcttgcagtgagtcgagatcgcgccactgcactccagcctgggcgacagagcgaaactccgtctcaaaaaaaaaaaaaaaaaaaaaaaaaagattctcaggctgactatcacatgtgtggatgaaggtaagagcctagaacaattagataacaagagtgaataaaatattaaataaagaatagtcatgattaaatcaatctctggagtaggatcactaaatgcatcaaacaaatgttagttgagtaaaatagaatcattgttatttttgagtttaaatattgaaatcgcaatcttatttaagaccaaagtaggtttacatttgctccatctcctcacccatttcccatattcttgccaccccataaaatgagaacttctgtcaacccttggaagaattgaggacaaagagctgaattctctccattgttctctgacttctctcatgggaagagagatgacgggttgagtggcaagagcctgacaaccattggtccatgttcttctgctgagtaaaatcagtgcattaagcatcactgcgcatgtacagtcactcttcttgggctcacagtggtcaataaggggtgaggagatggaattttctatgaagttctctgcctgtctgtcctgaaaacccaattctcaacaatctataggtccaagttataaacatggagtcaatggatagaaagacttctgaccttgtgttcaagctacattttgcaatccagtcttccaaattagaaggctgatgttttcatctctgactcttgcacatatttttaattcatccatggtttggaagttagagagttatgatggtttattattctcaaactgcaatactttttatttagttcatcaaaattaaagacaccacagccataatccatgtcactttctgcctcaaatctcaagattttgaccaaaacatatggctatggtggtctcttctagtttaaaagggcaaccatgttttcctatcattttatgcctgttcgcctatttgtggctggctaaagaattgtgaaagtaagagacattgtgttggagtaaaattaggagacccaaatttgactcccatctctaccagttaactacctgaggaaatttaggtgagtttcttaatctctgtactactcaggtcactcatttgtaaaataagaagaataaaaattactttgtaaaattatagtatattatctgaatatgataagatgataaaacaattattaaaaagaaaagatgtaatgctagtgctagatgctggggggattttgccattgaaaaataacctggaaataagtcaagactgatcatgggctgagttcaatgactcatgcctataatcccagcatttgagaggctgaggtaggcaagataacttgaggtcaggagtttgagaccagcctggccaacatggttaaaacctcacctccactaaaaatacaaaattagccagtcatggtggtgtgtgcctgtaatcccagtgactcgggaggctgaggcaggagaatcacttgaatctggaaggcagaggttgcagcaggactagattgcaccactgcactccagcctgggccacagggcataacaaagtctcaaaaaaaaaaaaaaaaaaaaaaaaaaaaagactgatcatagtctttctgtataggtcaatttttttttccattcttggacacataattttgctttaggtggtctggtttatgtctaaaacagaaggggaatgggttgagtaaaggggaaagaataaactaaatgatcaaagtcaacttgtttccagatgtctagatctaaaaggccacaaaagagctcttacttaaattatttgcccaaacaaaggagaaattttaaagatcccaagaggatgtggcattaagacagacactgtgatactcttggtgtagtcagggaacatcagaagctcatacttcctgacatggaggcagtgagtattgtaagagaacgctactcaatgacatcattcatggtcttttcacagccttcacctcctttgcctcaatatccttattcttcaaagtgttggtaaattgggcttgctgtcattacgcattttattggaataagcatgaattatgcaattagctttctcgctttccagcagcatatgcaaagtgaaccagaaagataagagaaaatcttttcctcaggatctgtagattagttcagcttttggaattttgctggcaatttgtagtgatgttgtcattttgactactcaacagctaagtttcacattttgggctgaatctggctgggtagggtggttacttgctttgatgttcttggagattctctatgttgcttggtactactaggctaaaatgtaatactgttctgtctgtgctacctaaaaccagtatgtttggggcctcatctgccttcagtagggtattttcctttatccttcgtgaaaatcaatttttttttaaatgaatgaatgagagagatgaaatgagaaggagaaaaatggttagggtagattttttaagcagtgcctttggcttttgttattttatgctaagttatttatcagtaattatcattagacaagctatactggggtgaaaagctgctgctttttcttccgtagccatgtgaaccctggggcgtgccgagggaattaaaataagaacagagcacactgctgttttatctcagctactgcaacatctctgcttgacaccctgtgttgaacaagagactatttagtagatctcaacaattatgcatgtactttcctggcagagaactctttgctgctttgtttgtcaagattatgttgaatcagcataaaaatcaggcctgacttatttctggaaggaagcagcctctctcgtaccattggaaacaatatgatcataataaagttttgcatatagaacatttcttttgagtgtagacaacaacttattcttgtaaagaatttaacatttaagtctcatatttccatacttatttctattgggactgctgcctactgccccacccccatcccccaccagccagccttagtttttggtatatttctagctctgtccatcttggagcagctacgtgaggattttacagctgtctttgtttctgatggaatcctaacccttttgtgatgtggggccttcatataagtatgtgatgtggaaaatgaagcccatgtgtgaatacaaagttaattagtatgaaaagtcccattttccaccacatttcttgccagcagctatgattaggtgcacctaagctttccaggtctcctaatattttttaactaaatccaagcatagagattccaaaatatcccattctgtgataatatagatgcatgacagaaagggaatgaatattggaaggtaatgtttgtgtgtgtgtgttacaggcttgttggagttcatcactttactttctgtacataaaggtgatttgttctaaatgttttaagcagcagcagcagcaaactttctgaagtctttaatcattgggatgattacttagggcatgctttaatgaaggaccactttaaaaagtagctccagagtaaggctgaagtccaattgacattttctctatgtgttatctaatggaaatgatctccatggcagagatgaaaataagacctttgaattgtgttgagtaaaataagatgggtcagatggatttgggcaatttggggatgatccttagaaaggagatagttgcatctggatggagctagggagacccagtgacagagggagcctgggatcatcttatggtgcatgtcatgtttgtgtagaaacgtacagtttgagcagaatacaaagttatataggtctaagaaattacaaaagaaaaccaacagcttcccctttattcctgatgctatggctggcagacaaatggggtcttcgaaatatgtgtgtgcatgcagccatgcacaaatgcttattcgctgatgaggatgcagtgttgatgcccttaggaacagcatcacttgtggactgggtggtaacaaagaactagaaagatgtgcttctcatatcttgatatcaatgtctatcagagaagatggagaaagctgagagatactagtctagcttgctgtgcaacccccttcttctgtcccatcctccttcttatgaaagacttcctaaccctcctcctaaagcctctttttctctgtattttacacctggtccatgcccttaatatccagtccagtagagatgaatatgcctagttcctggtgtcctgcttttatggccttagaaagcctttctctaaacatctctactcttcatgcttgcattcaggcttcatgtgaaacttgcaaacattgagcataataagaaagaatacatagtaaaccatcttaaaagaaagactataaattattttggcactaaaactattaaaaagtatatttcactttagtagacagcagagaaaaatctcttttttaagtttaaaagaaaaatgcattttcttagcagaataaatgagttaacagagtgtggtatggattgatcaaagacataaaataatatattttattgcacacttctagctctttgctggaaatacttgactataaaaaccttttaaaaagtagtttgaaagacagggatatagcacattgtttgtcttactagcagaggaaacaaaatgatcaatgaaagcagggtaaggatgaaggaatccttaaactgttttccatgcatatgattccatttaatcagcgctggaacaaaggatagcatttttctttcctttttccgtgtgtgttatttcatattattaaatgagatttgagtgaactgaagtaaatcagccaaaacccagcttggattagatcccctaaacttccttatgcccagattttttccagatggtttctcatgtcgccagtttaatatcaacagtgtgtgacacgctagaagaatatttcttagaccagttcagtccttgaaagataattatactgtcagttgccatcactgttactgtgaaagtgaagataactggggtaagtatattaaaatccagccccaaaccagcctgactttcagacagtgcatctaggaaccttcgctcatttttgtcactatctgtctatgctacccgacgtaacactggtatctttttgacagcaaaatgtctgcaggtcactttttggttatatgctgaggaaaatatgaagaatttttgcatgatgaaaaagatggtgtgctcatgtctgcttaaaaactctgatttctctgctttccactttaatttacaagttgaaaatgtattttcatgctactacccactttggatcttttttattgtacctctgacattacttatagcacatttcgcagctgggtttaaaagcatgttagcaggcaattgtaggtaccgtgtcaacaaatgtgggaaatagaacaagactaacacataaggaatgcctgcaaaatcatgatatgaggtgaaaataaaatggtttcatgaaaatgctttttcttctttttattttaatataatcacaatcttacagaaaagttgcaagaatgctggagagaaggctggtaatatgtttaccagagttaccagttgtcaacattttgaacatttttcccatatgctttttgtcattatatatgtatttttcccttgaacaatgacaataagttatgaacatcttgccactttacttttaaataattgagtgtttcctatgtacaagaatattttcttacatgaccccagataaactaccatgctacaaaattatagtgagtaaaatactgttgtttaatccacaattcacctttaaattttgccagttttcctggcaaatgtactggatccattgcatttaattgccatctccagttagctctgggatatcatgaagctgctttcaaaaatacagtattttaaaagacaatatggagcagctaccccagcaagcctgccaccaagagctgttacgtgaccgctgtgtcactgctcaccaaactctgttgtgcttctgcttttctggtaactaacttgcatcttacagattaccaacaggaagcatttcaaatgcaaatgttcatctgaaaataaatccctagagatctctgagtatctaaagaggtaaacacgcaaggagtctaaagttgcttttaggttgaatatgcacatttatttataaacatggctgtaaccataaatgattttctgcaaacttcatgtttatatggtgattacttcacagaattttcttatctacatatttgtttggaatttctgagatgatgagtgagtaggtgcattcactgaaataattattttagcatattaaataaaataccaaatagtgtgagatcctttcaaactgtaagatacttgtgtatgtagtttcttgagatatagaaagtagacttgtcagctgagcaacaagtcatgggtacagttggtattctttttttgtttgtttgtttagagacaaggtctcactctgttacacaggctagagttcagcggcactatcgtagcttactgcagcctcaaattcctgggctcaagcaatcctcctgcctcagcctcccacgtggctaattttttaattttaatattttacagacgcggtctggctgtattgcccaggctggcctcaagtgaccctcctacaggcatgagccactgcactcagcctggtattcttttagtagtgctgtaaggggaaaacctggtctactttaccaagccacactgggtttgcagttaggactcagagtactaatccttttcctgccatttcttagccctgtgacctcatttgccttatctgtgaaataaaacgactcaggcacgtgatctctgagcttctttcagcactacagttctgtgaaaaagttggacatctgcttatggccacagtaaaagtagaggaaaaaaatcattaatttaaaaagctgttaccatacccaagcttgttcttaaaaataatatatgcagttgatatccatttactcattagtgaaaccccattagaaatacaatccccagaggctgggcacggtggctcatgcctgtaatccaagcactctgggaggctgaagccagtggattccttgaggccaagagttcaagaccagcctggccaacatggcgaaacccaccccccaccgtctctactaaaaaacaaaaataaaaattagccgggtgtggtgatgtgcgcctgtaatcccagctactcgggaggctgaggcatgagaatagcttgaacccgggaggaggaggttgcagtgaaccaagattgtgccactgcactccaacctgggcaacagagtgagactctgtctccaaaaaaaaaaaagggaacaattcccagtttgaaattgaaactgattttgcttactgtatgactgggacctctgtgttcaggactttttccagtctcatacgttcccttctaactccattctacctttgtatttcttgtcattaaaagaagaagaaaagctcttggcattcccagtagtttgccctgtcatcatttccatcttattgcttaggccaagaaaacatccttcagttaatcatttgtgtgaataagcatcactctgaaacttatctcaaaagcctcccctgtttatctgcaggtctcttctaatactccaagtagttcttttccaattatgcagtaatttaccatagttacactgtttcctttcgtagttcttactgtgtctgtctgcttacacttacctgatcagcaaaactaactataccctgtatctcaaatgattctcatactgaaataaacaaataaaaattcagaagtgagaaagtggaaaagccagatcttttttttaatgttttttgtattttactaagcagatttatgactgaaagaaaaacattttaagcattttatcctcctctgttttaaataactattgtggggttttttttttcagaaaattatttaaatacactggctctagttaaaataacttggttttgattcatatattaatagttaaagtaaatattttgaactttcccatgaataagtacaatttagttagtcaagactttattattttatgaattatataaaaatattgttctctttcattcatgaagggaaggagaatctggtcatctagttggccagtgcatataatccactcagctgatgtagatatctgagtgtttatgtcaggcaaatgtgctccaggaggctgggataaagccacggatgtggcctccatgtggctcagcacttgagatgccaggacgcgctgccaacacctgggaataatagagaatgcgaatacctcccagattatcatagtatataaaccactccctgggagtaaatcaggaaccttgttcatgtgctttcaccctttccagactcctgggtaccttttaatgatcacttctgtagtgtattgcaggatactctggcaacaacttgaaggccttaatgtgactgccacaactgcctcgtaagttttcagtattggaggattatatcttagagagtctgtttaaaagccagtcactcaaatacctacaaggtccaggtggtagcacatgagtgaaactcgcactgggtaccatagtgaaagggaaaacttggcctgcttaaagagggcagctgtttctctgctccagtgaatggtaccaggtcagaatgtgggctcagagttatcacttcttcttgcctttaagaagaagctggaaattcagattttttgttggtgaaatctcctgaatcttaaatactggcaaatttacttcaaattaagaaagactgtaccagctaaatacgtctgtgggtcatcagtttgtgaattctgaaggagaatccaaaaatatattaatgtgcttcaacaggtaaattttctgttgactttagttggttatgagccacagggcctggggttctggctctaaatttctacataggaaaagccctgtgtttcctgtggacttgctatctcctatcctaccatttctctatcatggcaaagatgtccatggacttcagaagttctattgagagtttcgaggaaatctcagacctctcatcctttgtgtttctttcctggtaaaatggagattgctggggtccaggccttcagggtagaggacacatctgtatacaacacattgttttcctttctagttgatgcattagtcagtgtaggctaggctgtgccatataacaaactcacgtggaatgttcagtgactagacacacagagactttatcccttgctcttaccctatgtctaacagtgtgtgtcaacaccgttggctgctcagtgacctacactaacaaatggcttatttctctgtgatgctgccaccctcaacatagggcctctagggacttcatggcttaggaagagagcagtagcagggcacatcagttttgttcagaagtgatgcatattactcatgcttatggccctttgatcagagctagtcatgtagttccaaatgaactgcaagagaggctgggaaacgcaaggtcacacataagataaatatctcacaggagatatgtgctcctacaatgatgttttcctgaccatcaaactcagacttggggctcctgttaataagcaactatagatggttttagccccagtctttcctagatgccaagatcagtctctatgggtatgatctgtaagttatcagaagaatcttctagcttaagtcttgtgaatacaggttggagcttgggaacaccaggattttagaatccaaaagattaaggggcctcctcatccacagctgctgttcctctttccctgccatgtcatgatcacagcctgagagaaaggagacaaaaaatcttactgaaggccttgaccagcacgtgacttcccccaataattctgaagttagagttcaaccaagaaattgtagagaaggatgagggagggtcttctggttaactcctgccctgaatggttctatccctcagtttcacattggttgatcagaagtgtaagtttccacggtgtatgggggctgtgtagaaaagtttgcattttgggggttttgtgaatctttgttttcctggaaaaatgttcacttttatttcttaattattttttaattgacagataaaattgtatatatttatcatgtgtaacaggatgttttgagttatatataaatgctgtggaaggactaaatctagctaattaacacaggtattatcgtttttgtggtaagaacacataactttaattctttagcattttttaagaatacaatctgttgttattaactatagtcaccatgttgtacgatagatgtttaacttattctttctatccaactgaaattttgtattctttgatcacccctctagtccctgttccccagccacccaagtccctggtaaccaccattctacgctctgctgcgatgagatcagattttttggatctgcatataagaagtgagatcatgcagcatttgttttttctgtgcctggcttattttgtttagcattacgtcctccagatttagctatattttgaagtggtagcttcacaaagatgtagaccatttgttagtctgggtcactgagtaagcaaccgtgccgacatacagtgttagacaggttcattctactgcaaatgacaggatttccttcttgtatggctgaatagtattccattgtatatatataccacattttatttattcgttcaactgttgatgggcacttaggttgattccatatcttgggtatagtgaatgatactgcaataaataggagactgcagatatctctttgacatattaattttatttcctttggatatctacttggtagtgggattgctggattatatggtagttttattttttgaggaacctcaaaaaatgtacatatgttttcaattcatattgaaatttgtataatatatgaaacaattcctattgttttccgtaatggctgtattaatgtacatttccacagatggtgtgcaagggtttccttttctctacagccttgccaacacttgttgtctttcatattttttataatagccattcaagcaaatgtgaggttttaatttggttttgtgtggttttaatttgcgttttcttgatgattagtgatgttgagcatttcttcatgtagctcttagaatgttggcactttgaaatagttttaaccagtctgagcaaagttctctaatatgtacactgtcacagatttataggcttggggatcagtcttgatgggggacggagaatagaatgactacaactcgtatgtacatcttttagttatgaacgactgagaacccaattcaaaccagctcaagcaagaaaagaaattgattggctctagcaactaaaagtccaggggaaggactggctccagttacacttggattcagcactcaaaacactgcattggcactcacactttttctttcactattgtgttgttctccatgctggctttatgttgagccactacatgttggccctagctttagaaattctcaggttcattcaagtttagcaaaagaagtattagaatcctttcttgcatcctcaaaaatcctcagattcactcgaattggaccaatttaggtcacatgcccggccctgaagcaatggctatggcttgtgatgtggtgattggtttcatagatcaaactaaaaagtagaggttgttgccagatccacagacaaaaaaaagaaaagaaaaggaaaaaaaggtagcaggggatcaacacatatccactaaagcactaaaggggaaaatagataattacctcagtatttcaattatttaaccttagtatgtttttctttctacccactattatcatcttttcttgtacccgctggcttgggatactatcttcagaatcccctagtagttaaaactctgctaaagaaatttaactcttaaggtatattttaatctacaattgtaggtcaatacagaaatactttttactgaagccactattttatttttaacatggtgctatttgtacatctggaagcctgcagatagctggaaacagtttggatgtccttgaaaggaaaaatggttataatctctggatttctatttagatttatgtaagtcaaagaggttgagacagaaatgattattttccaaatatcttcccccatactttattccttttctttggtttattttacagatgtatctctgtagatagatgtgttcctcttgaaaatgtttgcagtttccctgttttttctttttttttggaaatgttactttgttaggaaaatacaccctactaattgcattacaaatatctagttttatcttagttataaactttatattttaatatttttaagtttaaaaagaagaactaaaccagatattgagacatttagatcctcatactggtgaaaaattaaattttgcttcttgtgcctctgtatctgtagcagataatggaaggcatttgtttgagagggccccaaatgatcacatgaaatatatggaataacattggccatatgaggatgggagatggaacttgtgttatttgaacttggaaacatactgttttccaaagtatattcttagagaactaatctgcaaggattacttggtcagacagatagggggaaatacgatgctttacttttctcttgaagactaaaaataaacatgtcattaagttttctggcaagttctgtaatttttttaaaaagtgtttaacactaacatcacatttacgaaacttattttgaccacagtttttttcccaaacttattttgaccagttttttgtttgttagcatgagcagctattaacatcccctggaatcaaagggccaactttgagaaatgtgttcttcacagtattgaaaaaggaacccatcatgtatgttggtaaacacccctttcacaaaatttaaactcttttcagtttaatcaaaaggaaagggagcttttcactgtacaaatatgattgaaagccctgtatatattcactcagatttctcaggtaaggggaagggtatgtatcctggaaatgacagcatgaacacttgccaagccctcatatgaatcagtgttcactcttgtaaatcataaatccattagccaccaagagaatttctttgttttattctcaaatttgcaatgaaacctgttcttaaagtaattcctttagtaatatacttgtgcaaagtaaaatcatctttaaaattaaccatttctcatatgtaatttccaaagttaatttctgaaaagcagaatataaaaattaaaaacaaacttcagtgaagttcattgtaatctgtctaaggtttattcactctgataagaactgctggtaaatttagctaatttctcagaagagctgagtctgaaaatatttccttataaattagtttatttggtttgtttatactaacagtacagttattttgatatacctttaaattatattatctgtactatgattttatatgcttttagtttaaaataagtatttcgcatgaatgcatgagaacccacacttattttatatttgaatgtgaaaagcgattctgctaaagaaattcactgccaacttactgaaattgatggagtgtatgtttttagtcagcatattatcaaagtgacatgcaaagcctgagaaagatgtagccccaggaggaaacttcatctgaggaccctgtaaatgcaagtaaatcaatttttaactacagaaaaattcaaattataaagacatcttatccacattaccttattacaaaatagaaccaataatatttgtattaccaataaattgaaaagtgccagaatgaaaaccacaagagtacttttcaaaacaatatcattaaataataaagaaggctaattgcagaaaatttggaacaccgtaaggcacataaagaaataccccaccatcctaacaccaaaataactgcaatgtgttggcatagttcattccagtctcactcatgttatatttcactaagccataaactatggtgttttcccatgtcgttttaaaccaagtgaacatcactttttaatagcagcattatatgccttcacatgccaaaacaaaatagtatttttcttaatgaaaatataatgaaaataaacttttgtttctattgttttgctttttcccctgagaataaaagcaagttcattgtaagaagggctggcatcagctttttataggagtacgtgcacagatttcaaattactgtgttctgttaggaatatttcataggaaaatcagcaaaggtttttctctagtttcctttccttagttctctaatcaaggcatagaaagaagacagcctaggatgagagaggccaagaactcccttataagtagttgtttggaagaagagtagaggaattgtaaaactcagccagataaacaattctattgaagaagccttatctgctaggtaaatctgaaatgtgttaaagtgattttacctaagccatactcctaccctttggttccttaggcctcatcaagcaacccccttgtgagcctcccccttctgaatctccttccctattttcctgatactctccccaccacacacccttattcctctcctgcgcttagggaactctggcacttggaatggtgtagccaaactgtaatcatgccttcataacattgtattgacaggcatctgtgacaatttcactctcccacctgattcttagagtaatgtttaaaaatttttggaatatccactcatgtttctcttgaatctcaaccaatccaaaaggttcagctcagtgtgattttgtgtgtgacatttccaatagttacacaccttagaccttggtccagcatgaggggataattaataagtacactttttctgcgggtgcttttggcaatactactcttaccactaatctctgagcataattgactacaaaaaaaatcatgtgctatttcataaaattccaagcatgtgcagacaccaggtagtatccaccaactttgggccaatactgcatacttggcatgtcataatgatttttttttaccccaggaagccatgctgaattctggtgataaaacacagtgagagaaacatcagctcttaattattttcattaaaaaacataattccaagaacaactctgaaatcatctagagtttggaatatattccagagacacacattctttctctttcttcctctcatcttataagatagggttatatttagttggcttttttcataaacatgtattttacctgaatttgaagattaaatttcttaatatttatatgaagaatgtagacaagcactaatggtgttttgttcagtctgaggagaagaaagttaacacaccatgaaagcataggaatgttttagaagatttttagctctcgcaattgggaatctcctggtttaaatttctatcatttcagcctcagggcaatccaaatcatacagggcttggacttcattgcatcaattctaatagtttttgcttttcttccccatgaaaacccccgtactttccttgtattgaggtgtggcttcagccttcaagggtccattctcagtatgcttgaaatctgaagatgaaatgaatttcataactggaaaatccagttatcaggcatgagcaaatggctgcatttgtttcagattcttttgctagtcgcttcattttcttctaatttaacaaggtcatgtatgaaattagactcagctgttatttattttattactgagctccaaggtataaatgttcctctcctatctagaaatttgctttcgactttctttctctttatatgtacgtacctatatcatgttttgcagcctccatagatataagctcaaagttaattttaccacgtcttttactcatctagaaaagaaaggtagccattctctcccagtgaacaatcaaattctgctgccttgaggaacaagtgatcagagcatttcgttttaatagaaaagctgtttttgttttgttatatttttttcttgcaaggtttgctttcagagctcttaaataaggatccactttcatattttctgcttgtgatttggactctgcttccgaaatgcatttgaagctgtctgataacacaaggcacatgtattataacatcattaaaatagaaagttaaaagttgtgggtgaaggaaggcaaacatttaccagcagaatgaatgaataccatgaatgaatgaataccaagaatgaatgaataccatgcataaatgaataccatggatgaatgaataccagctctagtgaggacctagggctaagccagagatcttactgagagccctgggcagtggaggcagaaaggagaaatgatggattacttagttctggttggagtggtgctggagtagggaaacctactggatcatcaggagaggcaacttttctatagcactgatttatgaaaggcatttgtaatatgtgtttttaaagatagggtagactttgaaatgattttaatgatttttaaaacatttcatggaagcatatcatgccctgagaaaagagcacataagaatagggctgcataaattttcacagactgggcacatccatgtaaccagcacccagagcaaaaactggaatgtctaagcctctcaacagtcccccgtgtctctttccggccacgactccctcctccccaaaggtaccattattgttgacttcttagaagataaattggcttaaacttgtttactttatatattttaaaacacatttcaatcatttgctctatctttacttttaaaataataattttgttcacttatggtttcatccatctattcattcaacttattgattcaaacaaaaattcttaagcacctgccatacgagtaacaaccatgaggtttagaatattttaaacctttcaattgtttcctattttttttaatttgtatgcactaaaattcacttcttttctctttctttctttttctgtgaatgattacatgaattttgacacatgtaaattaatgtaaccaccaccttacaagagattcagaacaatctcatcaccccccaaaagcacctgttaataccctctgtagtcctacattctttgcagacccctaagttctggcaactcctgatggagctttatattttgagtttcaaggcagtaatgaggatacatttttcattcttcatttctcagctgcaaacattccatttcaccttcctctatctctgcatctccatcatgctaaagtcatttcattttctgactgcaaaaggccaaagtttttctatccatattaagaaagatatttttctggtcaaaaattgcagtgttccaccagactgactaactttgttttctgcacaaaatgttttttttttttcttcccagaggttgagtcacttatgctgctgagcacaggaattttgacctttgggtgaggctcactctgaatcttccactgtgaataaaacagatcccaagatagagtggaaaagaaatacccagagctgaattaggagcagctggcagatgggctctgaaatgcaaaaatacccttttgagtttctcaaaattctagttctctaagaaaatatttattttttcccaattaatccacactcaataatttccccaagttatcttttgattgggaagttctgtaccacattgtagtaacaccgataacagtgaagtaggtggtgctttggaaggaaatcaatcaacttacattgttttatgcataacggcagttggaaaactgttcctatgatttcggtggtattctgccttctccatctgaagggaaacacttcatacacttgcctgtgtaagaaaggtgagtctgaattgcaaaatgggctttgttgataacttccttagtcttttatttagtatgtcatattacgaatgcaaaatatattccgtagagaaaagcatgaaaatacaatcaagcaaaagaacattgaaaacaccctactcctttgtcttcagaagcaatcactctttttttttttaactttttataatggaaaatttcaaatgtataccaaagcagagaaaatagtacagtgcagtcaacacacctattgccagctccaccagttatcgactcacatctactcagagttcatatctaccccaaccccaccctgcgctgagtattttcaaacaaatccaagacatcgtatgatttcattcataatcccagtgcgtatgtacctctaaaaggtaatattttaaaaaatataactataatgccatcatcacagctaaaaaacattaataactcctgtttatcgttaaatattctgccagtacaagcttctctgattaactctttttggccatatttgggtataaatcgttggaaaaaccactatttgtaacatcttggtatatatcctttccaactcttgtctttcttctccgtgcgtgcgtactccctgcgtgcgtactccctgcgtgcgtacatatttatgtgggcatgtgttcccctctagatttcctgccatagataaacacatgtactcatattcataaattggcttatatctgcaatacttttctggaacatcttttcataagagtacatgtgcttccctcattgttttctcccgtgactatttagaatctcataggatggattactattattcattttgtcatttccttttcactgttgattgtgaaccatccttcactgaaagtaaataacatttaaattatcactgaatataaggtcagttacctttagatattagcaaaggtaatatattggtgagtgaagcaatgagcaacacagaatctgtctctgatgactatttttgggcaagtgtgttttactttcagttaatatgcttgaaccacatgctcctataactttgtatgtttttgtagtttgtctgacaccaagttacactgccaggaaagtggccactgttcatattaatctggaaagtctgagttgccatgataagttgggtgcatgatcacaggtaaatagacacaatatttgagtcacagtgttttcagaccctgatgagttctgatgattcaggaccacttggccttatttacatttgtgatattctgcatgggtgggacgtgtactttggagtcagataaacaaagcgtgaatcctgcctccagcattttttgccgggtgacttagaacatattaacatctttaagcttgaaatgtcttcacctgcttaaggaagatagtaatagtgcctactcatgaggtggttgtgaggattgaatgtggtaatgatgcagttatggggccttgcatagtgcctggcaagagctcagtaaatggtagcagctttcagttatagttaaaagaccaaactaaatgccatatgccagagactatgcacagagagattccatttatgtacagtataacaacaagaaaatgaatctaagccatgagaagtcacaatggaagttatcttccagagggcagtggctagaaggaggaacaaggggctcctagggtgtcgataatattattttcctgaatatgtgctggtgacttagttgtatgcagtttcagaaaatccgttgagctgtgacttcattacttacgactatgcatcttcaggtactttatgtttcagtgaaaagctaaaactgaaaaaatataaaacaaacagtataacattaatcttatttgtggtaataaggcacctggcatatagtaacatagaagatagacagataaacagatagatatagcgatatggggaatactaatcattgttagcaatttgaaccgttttttaaaattaaattttaggaaaattgagttgaaaataatattgattcaagtcaaacactacatatattttgaattggtcgttctaaactcttctccctcatattttcaagacaacattccatatttaagttggaagcagatacttgctttgctttctctggttttctctcgggagaaaatattaggggtgcaactgtggcatcaccagcctcatcttgcctgtctagagcagagcagagctgctgctttgaaatgagttattgggagcctcagaaaccctgaagaggtttggccatacccagtagcaagctctgcttatcaaattgtcccaaagagtaattcttttctcataatacctccaagaagcaacaatcaattcatgacctttttttgggtagtgacatttcaagtgctcagaagaacatctgaagtttgagaaaatagacccgagaaataggtatttaatttacttgttctccagcaatcacactcattttgtcaagcagaatgaaatgagctaggcacagcatttcatatggtgaagcttgctgtttggtacagctttaactgccaaactgaggggagccctcaggatgtgtttgtggaatttcctttgtggaaaaatttcagttctcactgttgttagtccttttgtctcacaatcatacatgtgtacttaaaaagcctaagaggtaaaatatttgataattctccttttgaaatgcaatgcatacagtgtagtcagatttcatggaagtcacctagtgtagagattttaacaattaaaaactagtttaagcagatgggtcataatcggtatttcctaatgtgaatatggatatggaaaatataattataaggatgttagaccctctcttttgctgtcacagcacacagctggaaattgcttattattagcttgcaaatcctacaggaaaacacagaattatttttagtactcagcaaatttatggtggtaattatgagtacttgcatcacttccggaatgcaagagtcctatatctttagtctccatgttgagaagataatttttatcacttgtatgccctgcatattgatttctgtggtcactgggaatcaaaagtacttttctggtaatacaatgggtgacagtagtcattttgcaatgtaaatggtttggaaggctctgcagccgtgggtttcttaaatcttgaaaatagataaagtaaaaaaagaattgccttattttcccatcaccaaatttgccaatctacctgcatctgaagtcacaccttctgcctccttcccgtgacaatttggagtcattcttctggctctgttaagagtcaaatccttccctggtgtccgggatcctatctgcctttagcattacttaagaactccactcccactcccacactccatctccctgggatcatctgtgtgcccccattagtctacatgccgtaactgtggcctcatttactgcaaaagtcctcagagaattagctatgttaatggtctccacttgctctcctccccttctctcctcagtctagtccactgggtttccaaacccataagtcttctttataagtgacacctccatctactatttcctcaggctgagaacactggagtttataagttttcttataaactcaatctccaaaatgtagtggccaatggaaaacttcctctttaccctctgaaggtttgctgaaaatcaactgacaaaaggcagattaataggtgaaaaggcattcacattggttaacattcctggggagaaccagagtgattaccccatcacatcataaccataacaaatggttatggctcttcttcttaggggaaaggggagggagaattttagatgatttgggggattagtaaatgatttttaggggaattcagtgaacttgaagaatacacaatggcataggataaagtctgtggggcctgcacaacagacaatggttgggcctgcagaacagacaaagtctgtgcaggtgtgttgacagacttccatttttcttcctgcaacatgagttcagtcaatacaaactcagggaagggaccagacatgactgttttcttctttggcaggtctggactttaggcagataaaggaacttcagagaacaatccatcatgtgctttgggagagacagaggattgagagagatggggaagggagatgtcagagagaccttgaggcttctttttcagttcggaaggtggaaacaccatattataagatactggtttctaagacctgacaagaatatatttgcaatccaaccatttttcactgtctctgttgatgtgttcccaactccatcatcagtacacagacgtccactggttgtcacccaagccctgcttcttgctgaatctaatgactgtcaattatttggtctttttaaatttgacctctcttgatgaaactttttttctctttgtgcctctgtgacctccagttatttcagtatggagaacttaacaaaagaatgttatctgggtaactgaaagggatatgtagaattgtgtatccttatatgatgaatgtgttaaccaggtaactgaaaggtgtgaaaagaggtctctaaggcgttatggaggcagtaattgcaggaaagagccaccagcttgagggaagaaatctaaatgacttaaatgtagattttcagaggagcgtccctgaggagctgaaactctggcctctgaggagggaacttgtgtatttgaggtcacaggaggggcctgtggagctgagatctggtccttgaagaagggtgtgctggctgttgccagctctgcagttgctgagctggggactatgttatgtgagtattggaaaaacagcaaaatgaaataaaccactggctgggcacagtggctcacacctataatcccagcactttgggaggccgaggcaggtggatcgcttgagcgtaggagtttaagaccagcctgggcaacatggggaaaccccgtctctactaaaaacacaaaaattacccaggcatgatggcgtggacctgtagtcccagctacctgggaggctgaggcacgagaatcccttgaacctgggaggccaaggttgcactgagccgagatcatgccactgcactccagcctgggcgacagtgccagactcggtctcaaaaaaaaaaaaaagttctgccactgccagggtggagaagggagactggaggaggctcacgggagtcttgcctgttccctccagcacctcctagggccagagcctaacagggagccactcaccaatcaagaatgccaggtcttagccccatcccacaaagcagagtgcagaagggtgaatatacatttattggataaattaactaggaattcacctagtgcttggtccatgactgtattcagctagaccctgggaggcatgtcatgagtgcctggtgtgcatatactttgccttccaagctcttggcattttccttgacctcacaactagaaaaaaacatcaatttggttgtatatctgtaactgagagtgcttgtttctaaaaatgcagattatataaacatacagaagcttatatatacttggcaagaaatgtgcaattagtcacgtggtggaaagtccctccgcacgactcatgtagtctacctgctagaattctacttcttttatgtcttttgaaggcaaatgccatgctgtcacctgaagaatccactggcattctgttcatgtaggtagtagccttcctgtctttttgcagtgtggagaagggattgggagaaaagacgtgtcctgcaaaccctgagacatcaccaaggtttgcaaactgtggttcaagttcttcacctcttcacatccacaggagaaatatctgttctgacattgtctttagtgctaaactattgtaatcaagttctgtcggggttgagagatattccttacttagtagaaaatatctcctggagttctggcaattgaaaatggcctcggctctcacctgacttcccctgcaattgcaaaaaattcatcagctgagtcgggatgttaaggcaaaaatatgatttcttgaagagagagggaggagaagagaaaaaaaaaataagtgcagtgtggtctaccggtttgtgtcgatgctattcaaaaacatctctcaatccatttatcctttccaaacccaggagggtaccagtgccatccccttcctaattcaaggcctgctctaccttcaatggcctgtgcaccttgcctacctctggaactagttctgtggtctctttccctctcagttatctctacaacttcttagcttagaagtcctcttaacaaaagactacataaagaaatgtgaaaaacggagaaagtatagggaacacatttaacgggcagattatgtatcaaagctaatgtccctgaagtctcgatattcatccagccttttagcatcgttgcaagattcatcagtggagaaattggggaatgcaatcctgcttcattttctgcggagtggctccgtttggagcaggaacccatgtagcttgtaatctcctacgtaatcttccaaaggctttctgttttcttgcagacaagcctttatgctcttcccagtgccacattcctgagaaccctagggctccaagaagtgttctgtttgcatccttcatgccatgtgttttttgtttttgtttttgtttttttttcttattgagatggactttcactctgtcacccaggttggagtgcagtggcatgatctcagctcactgcaacctccgcctcctgagttcaagtgattttcctgcctcagcctcccaagtaggtgagattacaggtgtgtgccaccacgcccggctttttatattttctggtagagacagggtttcaccatgttggccaggctggtctcaaactccagacctcaaggccaagtgttttggcctcccaaagtgccgggattacaggcgtaagccacaacacccggcctgctgtgggtattttgtgatcacactgtcccctccaaacacaccttgtggaagacacttgctctgccattctggatttaaaataactaaactttaaaagttaggagtaattttctatctgggtattaccctaaagagtcttccaaacgactccaaagattttaccccatagaagtattcctctaagtgtcccctgcaacttcattaaatttatccgggatatttgttaaaaatgcagccccctggatctcactggagacttctaaaacagtttcagagagtgggggccaggtttacatgtattttttaaaagttctacagtctattcttacagaagcaaaagttgaagaacctctggtttattgtgtagatttttggcgtcatagaaagaaagcaaattatagagctaggaaaggaaaatattgccagcttaacacttgagttatctgagataaaatggaatagcttttagaaataattaagcatctattttcatgtgttttgggaaaaaaatgagatgtaatctcaaaccagtgattccattgatattacagttgacaatgaaactgaaaaaaataaataaaataaagtgaatctttaaagaaaaaccctaagcaaataaaagtaaaagggatttaaattggtggaagagttctattgttgttttcaaatccctgttcagccactaatgaacagcgtcacatcagacacacacgtttcttcatgttcccttccttgcgtagtgtacccacagggggcactggtacccatgccggggctggttaccaccttcccgtgggccacagcagcttcccagcaatgctccaggagcatggggctggctgcttgtaaaatcatgacgttattgtcttctgtgtctacttccactttcctcctcacccctatttttccctacaatgtcccatctcccccctgacctgtccatgccagtgactataaccttcatagtcctctagcttgacagaaaggaatagccatctttatggatttctccaacagacgggctggttggcaccagtctttccaggatggagcttgctaatcagatacacataatgatgctgatgtgccagtctaggggactacactgctatggtccaacttgcagtgacacagtggatgcagcagacacggtcagtgggtcagtggtccccctaccccctttgatctctccgtgtgctccatctgacttccagccaccactatctgtgctggagggttcttttttcttcttcttttttttcttttttttttttttagatggagtctcgctctgtcgcccaggctggagtgcagtggtgtgatatcagctcactgcaacctccgcctcctgggttcaagcaattctctgcctcagcctcctgagtagctgggattacaggcatgcagcattgtgcctagataattttttgtatttttagtagagacaggattttaccatgctgcccaggctggtctcgagctcctgacctcgtgatccacccacctcggcctcccaaagtgctgggattagaggcgtgagccaccatgcccggcctggagcgtcctttttaccaagtgcagagagccttgaagcccacagtgctcaggaattaactcccctaggagcatcactcatccagtgactctctgaatatggcatataaatatccaagctctctcccccagggatgggatcattctgtggcctgtagttgcaccttttccaagagctttccagtaggattaagctccagttgctccctgaatcatccgtcttaatagcagacactttgttggttgccttcttttccctatttcactgcctcattttttttttttaattcacacttcctgggactacctcaaaaataaactactagccctgaatttgtatctcagggtgtgcttctgggaaaacccattaccaaaacccgtcacactatcaacagaaacctcatagtgctgcaatgcctttcctttactattaaccaaagtgagaatttaggattatgcatccaattcaagtaaagggctggagtatctttctgattggggaaggacaaagtttgtaacagacgaaagctcttagcaccctcctagccaccctccagctgtgccccatatggttgttaattgaatgtcagttatggcttttccctactaataccctaaaatgcccttgttcatcatctatttgatctgttaatccagctaagcccatggttcccaaacattaacacacgttgagatccactagaggaccttgttaaggccacacattactggaccactacttcacccccagtgactctgatacagtaggtctggtgtggggccttaggatttgcatttctagtgggttcccaagtgatgctaatactgctggcccagggaccacactgagaactgctggtgtgagcctgcattcaccataatctcttgaaacatgaagcttggtgtttgcatctgagataaagcattaattgatttttcttttaaaattttatctattggttttgattaggtaatttatttacctggcttaaaagtcagagcatataaaacaatagatggattctttcttaacatgataaaacacactgatctcaatataaaagccagcctcatgctgaccaggaaaacactggaacatttccacagaaggaatacaacaaagatgcttattatgtctacctaatttatcattattctggaggtattctttatgaataatatagagaaagaaagcccaggagaagcaaatgaaaaacaaactatttgtacaatagaaatgttcaataacttggctgtgtacaatattaatgtgaaaatatcagtaaattttctgtacaagcaataaacaaagagaatatatagtggaaacagaagccccatttttcaaaaatatataatataccaaagaatatagcatattttaaaaatttgtgagatctacataaaaaatcttaaaaatatcctgaagtttacaaagaaagacttgaaccaatgaaagagacaatgttcttgagtggcaagactcaacttcatacatgttgctttcctttaaataagaaataaattcaatataattccaataaaatactatattagtccgttttaacactgctgataaatcatacctgagactgtgaagaaaacgtttaattggacttacagttccacatggctgaggaggccccagaatcatggcaggagatgaaaggtacttcttacaaggtggcggcaagagaaaatgaggaggaagcaaaagtgcaaacccctgataaacccatcagatcttgtgagacttactccctatcatgagaataccatgggaaagaccagcccccatgattcaattacctctggctgggtccctcccacaacacgtgggaattctgagagatacaattcaagttgagatttgaatggggacacagccaaaccatatcattctgcccctggctcctccaaatctcatgtcctcacgtttcaaaaccaatcatgccttcaaaaccaacagtcccccaaagtcttaactcatttcagcattaacccaaaagtccacagtccaaagtctcatctgacggacaaggcaagtcccttccgcctatgagcctgtaaaatcaaaaacaagctaattacttcctagatgcaatggacgtacagttattgggtaaatacagccattccaaatgggagaaattggccaaaataaaggggatacagggcccatgcaagtctgaaatccagcagggcagtcacattttaaagctccaaaatgatatcctttgactccaggtctcacatccaggtaatgctgatgcaagaggtgggttcccatggtcttgggcagctctgtccctgtcgctttgcagggtacagtctccctcctggctgcttttgcaggctagtgttgagtgtctgcagcttttccaagcacatggtgaaagctgtcagtggatctaccattctggggtctggaggatggtggccctcttgtcaaagccccactaggcaatgccccagtaggaactctgtgtgggggcttcaaccccacattttccttccacattgcactagcagaggttctccatgagggccctgctcctgcagcaaacttctgtctgggcatccaggtgtttccatacatcttctgaaatctaggcagaggttcccaaacctcaattcttgacttctgtgcacccgcaggcttaataccatgtggaagctgccaagggttggggcttccacactctgaagccacagccagagctgtatattggcccctttcagccatggctggagtggctgggacacagggcaccaaatccctagactgcacacagaatggggatcctgggcccagcccacaaaaccactttttcctcccgggcctctgagcctgtgatgggaggggctgctgtgaaggtctctggcatggcctggagacattttcctcacggtcttagggattaacattaggctgcttgctacttatgcaaatttctgcaattggcttgaatttctcctcaaaaaaaatggggttttcttttctaccatatcatcaggctgcaaattttccaaacgtttatgctctgtttaccttttaaaatggaatgcttttaaccgtacccaagtcacctctttaatgcttttttgcctagaaatttcttctgccagataccctaaatcatctttctcaagttcaaagtaccacaaatttctagggcaagggcaaaatacctccagtctctttgctaaaacataacaagagtcacctttgctccggttcccaacaagttcctcatctccatctgagaccacctcagcctttatcttattgttcatatcactatcagaatttttgtcaaagccattcaacaaatctctaggaggttccaaactttcccacatttttgtgtcttcttctgagccctccaaactctcccagcctctgcctgttacccagttccaaagtcgcttccacattttcagttatcttttcagcaatgccccactctactagttccaatttactgtattagtccgttttcacactgctgataaagacatacctgagactgggaagaaaaagaggtttaattggacttacagccccacatggctggggaggcctcagaatcatggcaggaggcaaaaggcacttcttacatggcggcagcaagagaaaatgaggaggaagcaaaagcagaaacccctaataaaaccatcagatctcctgagacttattcactatcacgagaatagcataggaaagactggcccctatgattcaattacctactcctgggtccctcccacaacatgtgggaattctgggagatacaattcaagttgagatttgaatgagaacacagccaaaccatatcaaatatcaatataaattttataaaattttgttaataataaaaactttttagggcacttttattctcacatcaaaatcgagtgaaagagagagttctcatataccccctcctcccacacaagcacagcttccctcattatcaatatttccaccagagtggtacatttgttacaactgatgaacctacattgacatgtcattatcacccatagtccacagtttacattagggtgcagtcttggtgctgtacattctataggttggacaaacatctaatgacatgtatcctataatatcatacacagtagtttcactgccctaaaaatcctctgtgctctgcctactcatcccttccttccagcaatccctggcaaccactgatctttttgccatctccatagttttgccttttccagaatgtcatatagttggaaccacttagtctgttcagactggcttgttttattttgtgaatatgcattttaattttctccatgtcttttcatggcttgataactcatttatttgtaatccccacataaatttttgacctaaatttgtggtttctagagtacacaaggaaaagtaaaatagcaaggttagctagaaaaaaatctataagagtaatgagaaaggactaacatcaacagttattcaaacataatataaagtcataattatttaatcactgtgatatgagatcatgaatagagaatagaaaacccagaagtagccttaaatacataaaaatacttagtatattataaaattatcattttaattattgataaagggatggaatatgaaaggtgtggaaatttgtgttattaatattgttactttcagcactgctttggatttgtttacacctagtgttgtggagaactcactatacgccaggtagcatgctagacatttccataggtgttgacttgtttaatcttcataaaaatttgtgaggcaagagttcatatttccagtttaaagctgaagaaacaaaggcccagagggattaggtatctttcttacagttgcacagcagtgaatggctcagctggaattcagacccagcctttaactccctacttagagcgatttctatacatggagcttctagcctcactaagtagtttgctggccatttcttttaccatatgtgtactttctgctcatcattatttcatttgagtctttcttttctggtgcagtcaacatgaatttctagttagcaacttagatcatagaattgattttaagaaaagattcgtggccaggcacggtggctcacgcctgtaatcccagcactttgggaggccgaggcaggtggatcacttgaggccatgagtttgagaccagcctggccaacatggtgaaaacctatctctacaatacaacaattagccaggcgtagtgttgcatgcctgtaatcccagctactcgggaggcatgagaatcgcttgaacctgggaggcagaggttgcagtgaggtgagtccatgacactgtactccatcctggatgacaaagaaagactctgtcaaaaaaaaaagaaagaaagagagaaaagagagagagagaggaaggaaggaaagaaggaaggaaggaaagagagagaaagaaagaaagaaaaagaaagaaagaaagaaagaaaagaagagagagagagacagagagagaaaaagaaagaaagagaaagaaagaaaagatttgtaactattttcttttacaggaaattgactaatttgtttagttgagaccagccaggtagaggaggattgatggtcttcatggtctgaactagtagttcagcggatttgagcggtacctttctggtattctatccctgggcctcagacagagagaatgtgatcactagcttgggaaatagcatggccagttctgagcaagagctgggaaagtgatagtgtgagtcttgggttctcccattcctggggcttctcccttacctcaagaaaatgtggatgggtaatgaggctcctctgtccagggaatactggctttccagctactccagatacctcacaggtattccctctgctcaactggtaaccaaccggtcaacaccaacatgacaagaacctgacatgacacctaattcctctgcttccagggcctgtcactgcccctctgtcccaggaggaggtaatcatagacacgttgctgcttacaatgatgctgagttcattcacagccaacttacggtttaactcctagttctgaggaaagccagtactaaaaaaaaaaaaaaaaaaaaaaaaaaaaaagacaattacagttcacctgttgagtaaattcatgatttactagtgatttctgacttttattttttcatctttaaccggaatgcagaccttgtttcattaggtttattatgtttttaattactttaggacctatttggtggctaattatctgtatgacaggaaattaaactgagcttccatttgtctgtaggcactgtgaaacctgacttccttcctcccaccctggcccctttcttttttcaaacaatgataacatgaattgtaaatctggaccaaagtgatttgggtgcaacatgctcaggctatgcgttataaaacacttagtgaacatttgaaagatggccagatttttgtcaattgattatcaattgtcacctgttgatcgattcaatgtagttgacataggaggctcttccaccatctcggtcaagtgtaagacctctcacgtctgacttctgaggtttaaaacctggcatttgctactcggtagctgtgaaaccttgtccagtttctaaaacttccaatgttttagtgtccttacctataaaatggggataataataagacctcatggggtagctgaaaactaaatgagacaatatgtgtaaatacatgtcaagtatttcgatcctggtacatagtcactgctcaataaataatcacttctattgttaagacagagccaagagttgcagagatgggtcagcgattttgttgacagccatctgttgtctatttcagataagagaagagcattgagaagagctgcatgtttctgctgaccttgatagtagaggcagggtttgccccttagtctgaaattaggcaggaaggcctgcaacatatggactgtcacatgctgcaagctctgattatgtttgctcttgacttctcagactggccaggagatgctaatttaaagctcacagtcataaaagattcgtccttgccttactttccactgtctaactcttgcagaagctctcagtaatgacttctacaggtggtgtgattccctccccaggaaagtataaaagcaagagaacaaagtaaataaaaactccctaattcctttagattttatttatattcccatagcaaagctgaagacattctttatttagaatatttgtctcagttgtcttcattatttgcaatctcaggtataaaatatgctggaataactggagagtggtgaaaacatctaaagtgtatttacaggcctaggttcatttttcaaagctttctcttcttgtcagcctttgtcaaatgggttcaagcttttaccagtaagaagcaaatattacattggtgcacttcaatctcggtagttcagaaggaacccttatgcccccaagagctaaatttaccaatctgagtgacatatctgcatggaggaaatatagcagcaggaagagagacacacaagcacacacaaaccaacccgggctgcaatgataattgcagtgtggcggtccctggtatcctaggagtaattactctgacattctttatcattgtgtgttagatgtgatatgaagcaattatcaagttgttttttggaatattgatgcctggccgtctttgcacattatcctcatctcatgctgtgacccacaggacttaattctgacaccttgagtctctcatggcagattgataaggagccctggcttaatcttccctttcttaggatgagactctggtgtttacccttgttattaaggagaagtactgataacatgcgctactgccattttctttttccacttgcagaattcgatttgtatctcaaattctctagtgcctggtctcctactgaaaatattggcacaatggcatttattgctaattgtaaactaccctcataacaaaggcagacattattgtttttccttataattacttgcaatagtccccgtgttaaccctattttaatagtaatctaaggactatggaataaggtttattaagaccacatgcttcagatctgtgcagactttgttggaataatgcttgtgggtatagaaatttcactcttcaagaggtggtctattttcttaagttgaaattggcattgtgtcagtattttgctttcatctgaatagctgtttctctgctcctttatttcatttttttctgagagcagacttttatttggagcatggatcagcatgcccacatttagaatatttcatatcatatcagcttgtttgtaccacacacaataagaggcatctggcatctttcagaaaggctggaggaagccacttattgatgctgtgtatggctggccctccctcgccccatgtacaaggtctttggtgaggtatgggttggtaaacagaaaaagcagtggccaaaccatgcttatagctgtggcctgtggtgacacaggacacatatctatctgtgtgttcttctgtggtcagtgctgtcatccctgggaagagatttcagcatggtggtttggaataatcaagagtgtgggcattgaagacaggctgcccccatccctacatgcaataagacccacccatattttatgactataactataatttacacaaatatggttgcactaaatctcatccttttctctcttttttcctttccttttttcttttttccctttactttgcttagcatgatgtttgaaaggcctatttgtgttgctggatgagcccattgctgctctgtgctctatggaattccatggtgtggaatctgacttagccattactccatgacagccacttcaattggctccagatcgtactactgcaaacaacattcttgtgtatgttcctcacagacctgtggaagaatctctttgatgtacaccttgggtggggttactgggctgccctccagaaaggctgcaccaagcctcactcccattcataacatgtgcgggtttccatggcccccatcaccacattcccaccaacactaggcattactcagctctcattgctattttaatttctgcttctgtgagactaatgactcttatctctctgttgacttttttcccatgataccttttatggaatgttaactcctaactttaatgtaatcaaattaataaatgtttaacatattgatttgtgttttcaaatttttaagatgtcctttctcacatctaagtgacaaagaagttttcataccttttcttcttttaagtttataattttacttttacattagttctttaattcaccaagagttcacctctacagatgataacaggtagtggtccagtttatttttctctatattaggtaataatgtcactaaaaagtccttctttttcctattctgttatggtcacctctgttgatttcttagtgttttctttgtttcgtgtttccaaacattacttcattgtctttactcttcccagtgttgctttttgagcttgataccaatccagttcttactctgcactgtattctgcatttcttagtttttctttttacattttctttttaggagcttgggcaagagtgaaatgagagattattgttaaggggtacagagttttagttttgaaagatcagaaagttctggaggtccactgcacaacagtgtgactgtacataatactactgaactgtgcactaaaaatggttaagatggtaaatttatgttacgtatagttcacaattaaaaacttggatcttgcaattagtttaagaaataaatttaggaatcctcatacaaaaaatttatagcacaggaataaactttatggaaagtaattagcaatgtatgatgagccttaagaatgtccattccctcttctaggtgtgtcctaaagaaaaactgagaaaaatttggagagagaatcatttaagtttattcattgcaacattatttatgatataaaaaatacttaatctaaatgttcaacctgaggaatagttaaattaaggctggtacttccacaggaaggaaaatgcagctatcaagaacttgttttgaaatatatttaatgatatgaggaatattttaattataacattattttaaaaataagaggcataactgtgactttagtatgaatctaattctttaaaaattacacatatatacaaatagaagttaaagtgggagaaaatacactaaaatgtaaacagtaataatctgttggtggtgggactatctgtgatgtgtgtaaatgctttgtaaactgtaacttggcacactaatagaggcagtggttgtaagtcactcagaatgaaaaacttgagctatgccaacgtaatagcctaatttaatacttaaaaacccatatttagcatttagcatatagtaaaaattttcctatactatctacatatattatgttactcagttctgccaactacctgtaagataggtactattactgttctatttccttcatgaaaaaagtgaaactcagatgtcatacataggaagctgaagaaccatgatacatgtacccagaacttcctgacattaacccctactttttaccaattccaaaataatctaaacaaagaagaacaagaaaaggtagtcataattgcctaaatgttttagtatcttgttggcttgtggctcggtcaactctactgagagctcctgttgatggccagacccaagccctgtgttgaagatgactgagcaaagagctcaacagaagagtggctgctgggaatgccttcttatggtgggtgttgtaatgcttttattttgcagactctactggggccagtgaacaatgagggaatgaagtacatcattccacatgttagctggttaaagtcatggcacttggcagcctccttgagaaggtactcagaggtccgtggtcattccttagaggcatattgactcattgattaaaatgtgctggatttggtcaacttcctccataacaagtcatttataacacatattatttaggaaatccagaatgctctgagagctaatttaaattataagtactcttgaaagccatgactggaaatgactctcttagcccttcaggcccttgcagtgattggcagtgtacttccaaagaagggcttttaagtggtttggttcattatatgtgcattctacatccaaaagaacccatgccttgcatgggaggaattatgaggccggagcactcctctttattagaaatgtaaaaacacacagccttgccctggtcagacattcctacacccctggagagtcctaacacgggcttaaggtccacagaatcattgcaaattctgaatatgcatattctctcaatggcagtacatattttcccggcttaataggatgttaaaatgtggctcttgattttggctcaggcataagacaatgcctgctatattccatggagatcatcctacaaaacttttaaaaaggaaaggtatgatcccttaaagaactcaaaccccttcctcatactgttagtctgaaaggattgtggaaagttgtttttatgtttttatttgtttgttttgaggacaaactttttgaagataggtgctggtatatggtgaatctcattcttctcccacaaggaggagaggtggagaaagtgtttgcttctcaccttaagcctagtgagaaaagcttcagtaaggccattccaagaaagtcaaaaactttccttgaagttagggaatatattggcctgaggcgtgtctccacatgaaaaatgtaaaagattagaaatggtttatcagcttttacagtggtgcaaagggtaggtcattgctctgttaggattggatttattggggcaaaggatacaagagtggtacacacagaccagaaagttggaaaaatgctggtgtaggactatcttggattctgtccagtagggctatccagaagtgtaaacaggccttagcagttagaatctaaagggagtgccggattccttggtcaagtgagagaaagatgatgaaatagagtagacacgtcacctgtaaaaggctaccagaggtgggcagtatctgatgatggcatggggttgaggcctttgaagaatcaacaaaaatgcttcataaaaattaattaacttcaaagatcagcttggcccaaggaaacaaagccatcttttctgttctctgccctctgcttcctcccttctttttaacccagaaggcagtagaaacaaaagttaataggaaaagagttgaggtcagccgggcacggtggctcacgcctgtagtcccagcactctgggaggctgaggcaggtggatcacctgaggtcaggagtttgagaccagcctggccaacatggcaaaaacctgtctccactgaaaatacaaaaattagccaggcgtggtggtgggtgcctgtaatcccagctgctccagaggctgaggcaggagaattgcttgaacctgggaggcagaggttgcagtgagccaagattgtgcccactgcactccagcctgggcgacagtgtgagactctgtctcaaaaaaataaaagagttgaggtaaaggaggaaggatgaccacaccccactttcccaactttccacctatgaaaagcaccagctggcaaaggggaaaggctttaacttcaaaacaaacatgtttgaagtttaaattattatatagtaatcaacattctaaattttgtgaaatactgtatctagtgacttaaagtatctttaagacacttcatttcctaagcatgaccagtaaagtcatggactgctcagaacttttttaagaagcagggaagaatgcctttctctaaacgcttttcttcgggggatgatgggagacaaaattaagttgctttgttccatcccatgagttgtgtctgttgcatgtaggtgtaataccctcagatgcccgactgaggttatcctgccaacccaccagtctgcacttctgatcttgccagtctggtaactgctctcagagcgtggtgctaataagacctggaaggtgagatcccaggattctaaagactagtcagttatctgcaatgtacattttgcaatgtgaactgagcaggagaatagggttgggtcagggcattcagagggaagataagctcaaagtgggtgcccttcctattgccttggggcctgacaaaaattatttcccatgctcactggaaacaaagtttgaagttaatatcctttactagggtttccagatcaaccttgccatccaataaaaatacaggacactctgtatttaagtataagcatgttctaaatatcacatggaaattcatactacaaaattagtcattgtttacgtgaaattccaatttcactgggtgtcctgaattttaactggaagccctaagcgaatcctctccctcttctgcataataggatcacatttataccattatttctttaaaaatgcccagtgctggagccatcaatatctgcaatgatcccagtctccacatcaacatttggcatacgttgtctgatacccatcaagagaacagtttaaagtgtttaaattgaggccggccgtggtggctcatgcctgtaatctcagcactttgggaggccaaggcgggcggatcacgaggtcaggagatcgagaccatccctggccaacatggtgaaaccctgtctctactaaaatacaaaaaaaaaaaaagaaaattagccgggcatggtggagcacgcctgtagtcccagctacgcgggaggctgaggcaggggaatcgcttgaacccgggaggcagaggttgcagtgagccgagatcgcgccactgcactccagtctggcgacagagcaagactctgtctcaaaaaaaaaagtgtttaaactgaaaccatccgagaatttcaggcctgtgatccttttaccactgccctttacacgaaacagtggtcaaacaccaataactgttcttgagtaacttttctgccaagctggaaaacttccagccgtgtggtcttggacaagccacttcacctccctgagttctcatcacctgtaaattgataataataaactcctaatgagaaccaaataagctaatgaaggggaattagcatgcaacaccataaaagtccttacaaatgtcactacatagcaatagtgtaggaaccaatatgtctatattttaaattttttgctgttggtattcagtttacacacagaaacacgcaaatgcatgaaaattactttttaaggtaacatacaactccagaggacctgactccctgaggacagccatggctattagaaccaccacagaactccaattaatcagttcagatgccttctccatggaatgcttttccagaaccccctctaagtatccagaccttttaaatccccctgtcttttcctttggctgccaactctaggatggggcacacaacctgagaaagatctcaaagatgatgagaaaagaggaagaaagagtgggtgaagaaaagctgcagatcagagctcaatatgcagccctcaatggtgcaccttcccctcacctagaagcagtgcaagtggttaatagccactattcttggggagctggcaattctccacactcctcaggccagtacagactaagccactggagcaaggcaggcctgtctttctaggtgacactgctgctgtgcaccgagacccctgggatggcttccagaagttcattctcactggtttcagcactcattctacatttgcttcttccaagttcctggcagcctgtctttacttccttattaattcattcatttttgctgttgtttttgttgttccggctaacaagacttaagaaaagcccatttgatcttaatttcgtgttgctcattatcagttctcttttaatcgttttcttatgatcttcatcaaaaaagttacctgtaaaacccaggaagaaaagtccttcatatctccccgccctccccttcttctttctctatctcttttgatgacaaagtggcaagtgactttccagagagctttaggaaatctaaccaaatgacaaaatagttgtgtgatgtccaatatactgaataaatgtcttacagaaaaacctttagcaaaaagcctggggaggaaggtaacggcattttaaaaaatcagaagctcagaggagacaaacactgcttgatgagcacttgagatgaatactacaagctaatgcgagcaatcagcaggtttgtggagaatatgctgatatctgcagaaaaaaaatgcagtggcagagaagagcttacagataaacacaggagctcaaaaatatatatattattgctagaaaaaccttgacattttgaccatcttttatgttgcaactagaagggaaatacagagtccagttcttacaactgaatatccttctggtaatgaattcattctaaatgttgtttcagaactcctctacatcatgcttcatcacatagcaaattagccaggcaacccctcattaataagaatagttaaccataagaaccaacaagaaacatacattaataacatttaaaaatttaaatcagggattcaacacaggaaggtaactcaattcaggatccatatttgttaccttctgttgagcattctcactactgactccctcagcctcactggggttccagttgtcagccccccttattggcaaaggagctgtctattggactgtccaagtggtatagggctcatcttttcacgcctctcaggagctcctctgtggatgtttcttgtaaagcctgcatttctttctttccttctgcagaaagcctgaacagttcaaaacacctccacttaaatgtgtgcgcccattcacccatcccaaatggcatatagtcttttagtgaacctcagctgaaatgaacaaaaaagaaaatttaagttcacaccttcatgcaaaaaaaaagaaaaaatcatactttgtgcttatagagatggtaatgaaagatatgatttaatagatgtttattggatgttgacactcacccatcccaggataagagttcttcaaggcctgctatccagtgatcggtgatcaccttaccgttagtttattggctctgactcgccaggtatcaataataaagcaacaaatattctgaccctcaagcatgactcatttatacttttaattaaggtttaacatggtgaaacaggtaaatttgtttaaaagtgaacttgaggccaggtgtggtggctcacgcctgtaatctcagcactttgggaggccgaggcgggtggatcacaaggtcaggagatcgagaccatcctggctaacacagtgaaaccctgtctctactaaaaatacaaaaaactagccgggtgtgttggcatgcacctgtaatcccagctactcgggaggctgaggcaggagaattgcttaaatccgggaggtggaggttccagtgagccgagactgtgccactgcactccagcctggacaacagagcgagactcagtctcaaaaaaaaaaagaacttgaactgtttcgattcttcagtcattactgaatcactaaaaataacgtgatggatgccaggatacactgtctaaatccctcactgaagaatgtagaccccaacctcctgccgtgatgggagtgttaagctggagctaccagcctctatacggattgacttagctaaagaaagcccgaggttgtatccgcattctaggtggcccacatctgatgaccaatcaacccaggagaacaaaggcctggcccgctagtttcaactcagcacagctctgaaaggtcatgctagtttcagactttcatcaagttgagttctgtctcctttgagactgacatactttgacttcaatcctctgcccagttttactgccctcccttcccgtctaagggtgttgatctcaagagcgcttcctcattatctttctgcatgcatatcttcatttcagagtctgccttctggagaacccaaacttcagtagctacttcagtttgttttagactattggcttaacacacagagacctagtgagtttctttattagcccaggatctatgaagaatgtgctaaataatactctttccctccaaaaacatcatacaaattgttcgtagttttatccagaaaacagaagcctcttgaggagagagtagtggagaatgagtttggtaagagaagaggagtctagaataaaaatgcctgtgtaatgagggcagaagtgagactagtaggaaagtagacatatgcataagatatttccttcaactacctaaataattgttgataaccctgccattttacttcctgcaatggaatgaggtctctactaatggctaccctttgggagttcttatagtttttttttaatatgtcccagaaaatttaaccaatgcccattttcttaaaaaaaaaaatctatcctatttcttgcttgtgtttctgtctaaaaattacattggtgtaagtgtgggtgtgagtgagggcatgtgagggggaggctttatttatattgtgtctttcagagcctacagctacttctaattgaagcacaataataaatatgactagatcaaagaaatgttaatattatctgtggagcttccttatttagactttgaaacactcattaattttctttgattcatattcagaatatcaaatcaagatctaaaggaaataggctggagtggtggctcatgcttgtaatcccagcactttgggaggccgaagcaggtggatcctttgaggtcaggagttcgagaccagcctggccaactggtgaaaccccatctctactaaaaatatttaaaaaaaaaaaaattagccagacatggtggtacgcacctgtagtaccagctacttgggaagctgaggcaggagaatcgcttgaacccgggaggtggaggctgcagtgagccaagattgtgccacttcactctagcctgggtgacagagtgagacgtctcaaaaaaaaaaaaaaaaaagatataagggaaatagccataaatctattcatagataaattgcaatctggatggaggaaagaggagggaatgaaacttacccctaaaggcagttaaatatttcataagggatgcaggagccatgggctttttcaccttttaccatttgtgaaagccagtttttccagtattgcaggaaaaatcactacactagttagcataaaaggaaaacagaagagaatttcaccaagcctgtcaactgagagagtcactgaagccagcaaagattattcatgttcaacctgcagaccttttagaggacatcaaagatcaaaggtttacccaggaatgttttcctggaaagagtgtctttaattgttttaaaaaaatgtattgaacaatatgtgttctggaattgaactttggaataactcatcactattttaaattagtggtcattcctctattccttgttatttccaagcttagtatctgattcctaattccagtagagtccagaattaggcaactgctttttatgatgtcctgtttgtaggctagctttctgcatcccactgcttctactagattgacaagatgaggcaccttagatccactgtggaagtatatgtaccacatgggcttctattaaggcatgagtatagaaaggggaaatggcccaaaccagagagttgcacagagttttggcatccacaaactcagtgcagaggaggaaggattgatcaaatgagcttatttggttcccttcttttctccttcctccctctttccatcttttctccctctggcttttaaccctggttgtgaaacaaaattaccaattcagtttttttatttgcctttttaatgtttttaagaatgcctgtgcccaagcactgaaacaatttctgggaatggagcctgaacagctttatttgtaaaaagcaccacaggcaattctacagcagggccagatttgagaagcacagagctcctctatccaaaagtaaagcaccagtggacaagaggaccaaatgggacgtgcccagctgtaggctcaaccacaaattgtcatccatctccattaagtgataccacagaatttgtataccacctctcagagtcattattaacttcccaagaatgccacagtgttctgagggacgcagatacatgccaccaacatatgagaacattcttggtgaaatacgatttggggttcttggttcttctggggtttctgaagtctttatgacacagcaaagtctgtgctacggggacactattaactccttagtaactggttatcttagagttgcatatttctgttataaatctcaacaattatgatgaaataatttcataacacatttcaaaagtgtccacccttctttccctttagcagttcatgttaatttttaagtagtgaccctttacaatttctcacccaaatctggccttttggaaacagagctataaacggatacactgtggatggagttttactggcaaaaggcattttttaaaaattcccatatgttcctttaagtgattttttttgttctctgaaaccaaaaagcatatgttgaatgattttttcctcacactaatatgtcgtttcagacccttaccaggtctcttaaatcttttcactttcttcttttttcatctacctacaaggcaacttatgtgtagtccatgacttgatctcttttatttcctttgtatgaggagaaattgtgcctggatggaaaatcatgagtcttcctctctctgagcactcttgactctcctgtcttggggcatcattctttgtaatatagatttttttttcataatttcccacagttgccatagacagatgcaaaatgaaaagagggtattgattctctttcttttgtggggcatagactctttcagataacttcagttagaaaaaacaggatgtaagcgtgtgtgtgtgtgtgtgtgtgtgtgtgtgtgtgtgtatcagtgttggttctcaaccctgatttttcttttggagtaaatcagtgttggacccaaaaagcaaaaccaaatagaataaacaaaatgaataaactaacaattacctaatagctaagaacatgaactctgtaatcacatgaggtcacataacatgtataagtttgaaaatacctatttggaaaaatctggtgaaaacttggttctaatttagaagcagtagttctaatgagttttgtgtataagaaataggtgtgtcttagtccatattttatgacatagccattgttgtctagagcctcgtgaaactcactttccatcatgtccgctaaaaccattccctacttcttacaccatgtcagaccttccttgtgttgttcaagggatcttatatttctatttctaagttacaggtaaatcacgatgcttgctggtatctcttcacagatgttccactgccacatcaattcagcatataacacagtgaactgattacatactcccttaattttacttcctagatacttgtcaacctgtctctccccttctctacttttaatgcctttgtttggatttttataatgtctcatttgctctattgcaaatgcttctggcttagtttttctgtctctagtctcttaccctccaaatctattctccgcctgtgtgagccatctgaaaaaggcaaattcactatgatactttttcttgtcaatttttcagtgtctcagtcgcctttttagcagaacatataagaatttggatggccccactctcgactcgacttctctaggcaaatctaaccatccctgattcagacgctaggcttctgacttctcacacatctcaggctttttcctgcctctactcctggcttgcttctgcctccacctgggatgctgtttttttcttcttcagttgattagttggcgttcatttttcaggactgaacacaggtttcagccttcctgtgggtctgggcttgttacttctttaaccctccaaggcctcctgaagatttctctgtgcagcacttgccacattaaatcgtatggtatttgtgtcccaacgcactaattttaatgttgagaacagagccttgacaacttcatcttgccacccctatcatgaagctacaagtatatgctcaataaaaactttgcaaatgcttaatccagaaggaaacttacagattaactagtagaatgactttatttcaaaaattggggaactggctaggcgcagtggctcatgcttgtaatcccatcactttaggaggccgaggcaggcggatcacctgaggtcagaagttcaagaccagcctgaccaacatggagaaaccccgtctctattaaaaatgcaaaattagctgggtgtggtggcgcatgcctttaatcccagctactcgggaggctgaggcaggagaattgcttgaacccaggaggcagaggttgccatgagccaagatcgcaccattgcactccagcctgggcaacgagagcaaaactccatctcaaaaaaaaaaaaaaaaaaattgggaaactaagactgggcatggtggctcatgactattatcccggcactttgggaggccaaggagggagaactgcttgaggccaggagttcacgatcagcctaggcaacatagcaagacctaattgctaccaacaaaacaaaaacaatgggaaactaacatacaagaaactgaaataacatgtcagaggctaaatgtgaatttgtagctgagttgaaactagggcccagatatccccattgccttctgacacattttattttgagttgtataatttggcgtattcatgagaaacattgttaattggattatattaatttcccctaattaggtttgcttgggaaattgcagagatgctcagttctttcctgttcacagtgacccaagagcttgatacttttcagccattggccatttcatcctgcatctattctgctcttaatggtactctaaatagcttattttgcaatcttaaaaatctcatgcattatgtcagtagagatgtttgtttgtttatttatttattttttgagacgaagtctccttctgtcacccaggctggagtgcaatggcactatcttggctcactgcaacctctgcctcccgggttcaagcgattctcccacctcggcctcctgaatagctgggattacaggtgctcaccaccacacccggataatttttgtatttttattagagacggggtttcaccttgttggccaggctggtctcaaactcctgacctcaggtgatctacccgcctcggcctcccaaagtgctgggattacaggtgtaagttaccgcgcccggctgcaataaagatgtttctataagccaaactcattgtaattctgtgtgatacattaattcagatggtataaatgtttgctaactaaaatcaatatccagagatggaattcaagaagtgtcatctgagttgggaaaaaaatagtgcaactgatattttggtacaacttagccatggcttaacccatctcaatacagccacatgattcttctcctagcatagctactgagggaagaggaatataaagaattctctacttctcatactggttacagggcatgatattctttaactttgtagattgcgagatataagcttgtgtcttggttatatgttgcattattgtcacaaatttgtgataacgtcctgtatcttctccctgttttacctctgtgattaaaatatttttcaaacgtgcactctctccctgtcacctccatgggaagagcattttcttgcaccattaagccttgtgcttggccacaggacataacttggtcaatggaatgtcagcagatataatgtaaacacaggctttaaatgccttgatctcttatgctttaccattgccatggaaagacctttctctgcgtagctgttatttcctcacccttgttctaggaggagcacacgtgcaaagacctagaccaacctgcatcaaggagccgagcctaactaggcctcagattgaagcagtttcccagacaagcccaacccagatcaaccaaccactaagtgacccacagaggcaagaattgatacatttaagtcattgacttttgagtgatttgttttacagccagctgattcaactcctccctaataggctacttaattaaaaaaccttaagccttttgcataattgatcctaggacacttgcttctcctgctggtcttcacttccttctcttttgctgctgtcttaggctttttgaagtcctgtttaactttagatacctgtgcttgtgttcttttaagttgcttttcttcaatttctttttcttttcttgctcctttacctgatctgctacttctcctggaatctttttctttatgttatattttatttctgcttttatcttttgctgcccctctaaatgtctttaatttataatttctctccccttatgtgcctgatgctgctcattctgggctcttctttttgtttctgcctctacccaattcttgtgggatgatgtcccagctacatcctgctgttctttcacctgctctattcctccagaagcagaaaggcagacttaacaaatgatctgaaatcctccccttgaaaattccaatttgctttctggctccaatggcccacccacccccaggtgctctgggatggagcttattaattacactcccttcagactaccctgacttgaacagagggaaggaaagagagaaagtcgatagggaaggtgagagaaggaagaacttgggaatcttattaatggtatctttgttttctgaaatgagaattggagaaaacaaggcatacggtgcattcattgttttagaactgagaaacaagctcctattcgtcttgccaaaaattgcaaatgtgtgtgattcctctccattagctcacagcaatattggaaatgtatttgactaaactggaacacaccatcagcccaagatgcccagaggcagctcaatacagccatccatatgcttctctgagttaatttggaatacagagaattcagtttccaaactgtccccatgaacatttgtaaaatcctgcccatgtgagtggaaggtgatctgtaccaccacatgcaagctctcaataatgccggaggactgtgtcatgatagaatgcaaaggaacgacgggaggtattgagacctgcaactcttaactgctactgttttcattggtttaaacatattgctttatagaatttctgatttctcaatgctttattaaaggatcagcaggggttaggcagttgtagtgtaaattatataattgcagccaccacaaatgtatataatggccctcggtcgcttaccagccctctcaggggatacagattgaccatagttactcaactcacaggcaggaagtcccagaacatgctattacttccttctatagcatcatagtctgtgcattcttctacagattatcccaggcaatgaattgcatttaatattgctgtgggtaatatttcttcttctgtctcccttttgctagcactcctggaaatagctgaagcacagtacaaatacttacattgcaaaattatgttaagaatttcacttaacgtaaactgctccctagctcatatatcaaacatgaagtgggtagattgaacttccgtttgctgggcaacctcagtatgttacccatctacttctcccacaaccgttgccactttatctcttcccttcctggacacgatcttagttgcctagagcaccacaaactgcaaggcttaaaataacagaaatgtattctctcagtttaggaggccaaaagttgaaatcaaggtgttggcagggttgattccttgcagaggctctgagggagaattcattccttgcttctcttctagcttctgatggccgtcggcaaccctaggtgttcctggacttgtggctgtgtaactcccatctccgccttagacttcacatggccctctcctctgtctgtttcttctccttttctttctcttacaggggcacttaccactgggtctaggatccatccagagatgcatccaggatgatctatcttagcataataacatctgcaaaggccctttttccaaacacagcagcagtcacaggttccaggtgggcatattatgggagaccaccattcaacctactacaggcatcttgtgtaggcaccctgcctgcagctctcagtattctctgcatttaccgtgtgctttggatttggagttgaccagaaatatctcctcacctccactgcagcctgttctccaacctctaaatcggtgttggcagtggaaaaccactggaccagtaaaaataattgcgtttctggcctggctgtggcctcatgcagaaggcagaagagaagccagatgctctttctcatttcaggctattcagatgactgggactttcactgactcacttcatcttgtgcttttctttttatgtcttttagccaaaaatctttttttttttttttttttttttttgcccccagtgagcaaagtccactctgccctctcagtctgccaatacccatggatcatgattgctattttgcaatcctaagagactcatgtcagtctgtacagctaagagcacactgctcattcatggagagcctgctatatgtatgtaccagacactgcacatgatgtgaattgtgccttatttagtccttgtaacaaacctttagggtagatagcaatgcttcattttacaggtgaaataactgagtctcaaagaagttacctgcctcccccaaaaaatgcccaaagataacacaatggcagagtcacgattggaagcctgccctctgattctgccaccaagctgtgtccattggcatccagcttcctctgcacatcatttaatcacttgctaatttggcatatatgctctggccattttttatacctatggttttctgaccaaggttgttaataaacaccctgcatgcttgccaagcacctacctggtgcctagtctattcttctacttccagttggtgtgcatgaaggaccctatagttattttagtagagtaggtgctggtcacagtcccatgggagtgaatatgccagctagcatccctctgatgttctcttgtgattaattacctgtgactctgattattccctcactgtgaccccctcggcacttacatgctaaggttgtgcagtattcatttgttcttgtggaaatatggctctgtaattgcttctaaacaattttatttatgcatctgttgtaggcagagatctaaatctagcaatttaagccattactagatgatgtctataaggctccgagcaaattcccgggagctgggcacgtagtggggattgggcatcctagatcaacatgcatttgtgtgtatgtctgcataacaaagcaccttttaatgcaggtcagggcttttttcttgtatttattccctagttctccatcctcctaccaccacccggcaacacacatgttgcagtactgcccacagggagctaacataatggtgaccgactggtggagtcgattttcatacagattttgagaaagaagcagatatccaagccacagcacactatgggttcatttgctaccttagtaaataaaacccgtggctttaattccaagaggagttagtcttgtttcaaattatagaatacagccaatacagctatagcatgagccatgccggctcatgattgttacctcttggctgttgcccaaatctgaacattgtcttgtccccaagactttacttctggcctggttagaaaaatgttctaatctaattgtctgcctctattgcgtcgactcttctgggagataatggtccctgatgctgttccacatcctcacttttagctaactttgcataatgcacattacattatctctgtcttctcccattaaggcctgcaaaatcatgggcgattgattaaggctgagactaggctagaaatttcttttgcaatgaagctctttcaggagtaacattttttaaaaaacatattcataggacacgtagcaaaataaatgagactgcagacctccacgttctgcggaagaaatgctctgctgccactaaagctttagctattcatcaggggcaatggaattagagtcacagacgttccaatattgtaagagagaatgaatagaaacgatggctctgttgttttcttgtagtcgtttttaaaatggtctgtagaatgtgcctctgggcagaaaggaatgaatgcaaaaaagagaaaattttacacatttctgttaaacatcttaggcttctggctatagaaaataggacagcttcttttgagagaagtgtgtctagtgcattttcccatcacttactaataaaacaggacagacagactgacaggctgcctgaaaagcagcctcacagtggaaggacagcatgatcacacatttcagcctgggcacgggagccaagagactgtcatttaataagtggatgaagaaatcattttccctgtggcaaaaagggagagaaatattcagctgcatctctagacctctatcaggttaaaatgaatatgttaagagaattaagctgcacctcctttattagtgtgacagtaccctggctagttggctatattaaaatggcagacacagtgaccctgttgaactcttcatgttgataggcagtcagaaaataatggctttatagttctgcatctgctcagatctttccagatttgctaaaatttccaacgtctttgtctacttattatgacagcttgttctctcctgattggggtctttattggcatgtgagcatggcagcattatattttggcatgtctgtgtaatactgcagaaatcaccttacttcaaacttatttcggtgcctgtccttcctgccttgaaaaaggtggatagcagtataatgcttagacatcaaaccttcattttttctctccctatgaactctaaaatcattttaattgaaacaagaaggtttttgccccctgcattagcatgtggtgttttttctttgtatcaatcaccacattaagaattttaagatatcatcccattaaagctttacaataaccatgaaagctatttataatgacctattccactgataagaggacggaggcttccagaagttaatctggcataaggccacttggctgggattcgaatccagtcttttttgacttcgaaatgtttgtggttccacccactctaaggctgccttcacacagtggaacttgcctcttagtgaccctgttgaaaagaatgtaggagggtggaaagtctgaccgtgttatcttaaaattgataagttggctgaatacagaggcatagtgactgataatccaaatggcatggattgctgacctgctgctgtcatggctcaatagagccacttactatttttgactgcaccttacacctatgggagcaggtggtgtgaatgagagatgggaagaaggggtaaactttctttctaaagtaggattatatcaataacccagactcacaggtgtaacttgctgcttttcagttgtccgcaggaaaaccagtgtaagtcagttcattcctgctgtgtgatcttgaaaagtcaccttaattaccttaattacttccatattctgttggaagaaaagaaaatgaatgtaaagcacctaacgtcatgccaaacaaataggaaacactcaacaaatggtagatttagatgattctcttcttgtctgttatctattctattatccatttgttattcctagaagtgaaaataagtattacacctttgttgataattttctcccataaccagttcccctggttactcccattgcttgctgtgtttcctagcttctaaaacacatatttttttccacatttggaaaatcctggaattgcaattcattttataattggagtaaagggaagcatgccagctctccagaatggcatcacctgtgaaggtgtgctccaagccacatgttcaaggtatctcttcttctgattgtcaactcaggtgagctatttgcattggcaataccacatacatctaaattttaacgtaaattggaatcactacctattgctcagtataccacatgccctgttacaataaaaaagtattgtatacaaaaaggattgtcatgggagtgaaaatccaattaaagacagtagacataaagaattgcaaagctcgaggagattgatatatcttaaagaaccaggactcagatactcttggttttgataacatacagaataatgggtgttaacttttttattaagtttctaagatctctgccaaactaatatattcatgcctctattcaagagaaaaaaaaattcctgccagataattcttacttcttgctttaaaaataaaattctgcatacttctgtttttagcacattccctgttcctctgaggtaactttgtctctgctttgctgagatgctttctgatcccatttgtggtgtgtgcagggtatggggaatggcccctaaacatgccttccctgaattcctcatttgctactgactttcctctatcccgaaagggtagccaaggtgaaggcctcgtggttctgaggagacgacagcacccaatctgcaccaagttctactcaaaacacaggcatgctcatgtcatcagaatatcgaaatgcagaccaggatggaagagcttttgaagaaggagtgtaagatcgcatccccaacctgagtgaattcaccccctctccatgtgaagagagagagaaacttctgcacactgttaacctagatgtgaaagaggaattttcagagatgaaaaaccatttccaggttttcacagggtcaagttggtaaggtgggaatttctagtttttcaggaaaaatctagagtagtggtcacaaaaggtatgttgtcctctcgatgcctcagggtgagagggaggacaccttcatcagagctgagagagggactcccgtggggatgtgtccatggagatttctagatggcacccagagatcatctgtgattgagccggcactcgatactagcagcacaagaacccagaccagtgaaagtatgagcagaagaggccagccaagaagtgaccacaggccacacactaccacacccaccatggtccaagggcctgtgtcggactgaggagtgtcctgctctttcccaattccactttgaagccctcacacacaaaaacagacatttatccctccctgccactgccagatgacagttgcaaaattagaaatcggactcggggaagaaggcagggaggtacctgtgagaagcatgagggagccctgagatgcacattatgagctgcagtgtaaaagtataataatatattaattccagtgaaactcccaagagagactgtattaaaccaggagtgactgaaaacaaatttggttactaaatgaaataaataagctgttggttccaggcagatcgtaggccaaagtggaaagctggtatttgttatgagtaaaagtgagggcagcctcctaggtatacacccctggtgggtggagtttgtctctcactccatcagttccccattcttttttttttttttttttttttgagacagagtctcactctgtcacccgggcctggagtgcagtggtgtgatctcggcccactgcgccctctgtctcctgggttcaagtgattctcgtgcctcagcctccctagtagctgggattacaggtgtatgccacgacacccagctaatttttgtatttttagtagagacagggttttgccatgttggccaggctggtcttgaactcttgacctcaagtgatccacccgcctcggcctcccaaagtgctaggattataggcgtgagccaccgtgcccagccagttccccattctttatgataacgtacagtcatatcaaagaagaagttcaaagaagagttcctttacatttgggctgaaacctactcttggaccttcacctggtagctcattagtgttaacctaagaaccctgtttttcacctcagcaggcctgttactctggtaaacgccccaggacatgactgctctgtctgcccttccatacctctagacgctggcttggattgttcttcaccctgaattgcctggttctaactttaattccatctcaaattggatttcctctcttgcctctatacaatcttctctaccatccctcgtgctagtaaaactcttcttccagttctaactagtgttgataggcccatatggtattctgggctttgtcactgaaaatcctgaaattctttgcttcagtcatttgcagtgattcaggtttatggagcttctcatgttacacatggctactagagtggtgtacccatatggggttcaatttcctaactcccttctccctgactgctaatgcttttccttctgttcaggctgggcacttcagatctcaaacacaatttgttagtatccatctccttagctatggtagaacagtgacttctccagggatgtttctgagttcgagactaatgttccatttaccacatctcaagatcctgttcctgttttgcggaataatccctgctgcactgtttttattttgtttttttcaagttaccaggctttgtgctctttttccctgtagtttttctcccatgtttatctattgtttcctacgaatatatgctgagagtcagtgggcctagtgtgcataattcaaatgtggttcgacagcacagggacacaacagacatgattagatcattcatgtttagatcaggaaggatgggggaaaaatttgatttggggcttggggagcacagttaacgtttttccaggatagccaaggaggatttatagtaatttttaaaaattgtgtcaggccaataaagtttatgaactagatcccgtcacaaaacttagattgaaaactcatccaacaatggctaatagctggaaagaaaatggttgccctatgtttcaaaacaaaagtagagattcagttgaactgataaatatgaatgtgtttatacagacaggtgaacataagttttcagattgggggaaaatgcaaagtatacacatcccatatattcatggccagagaattctatcttgttcatcattcattcatttcataaatagtaggtataggcatatcaactacgtgccaggcactgtgataagccctggggctacagaaataggagacatggcttttggtctcttactaggaaacagaatagcttcaggctgtgtagtgcaaccatggtcttctgtgctggttgtgttaggtagggaaggtgggggtggagaggaagttcagggaaggctttctggaaataatgatagctgactgaatattgaagggtggggacagggttttaggaacaaagaacaattgatgcaggcatggaaaacaagcatggaacataccacatatggaacatgtgggtgtagaagggaggatgagtgaaacagggcaggtaggatgggcacagatcgagatggggggtttttgatgtgttaagagattcagattagttctctgatgtctctagaaggccatcattagtcttttttttttttttttttttttggtggggtgtatttcaaatactgaaaaagtcctttgggctcttggggctccccacactcatggttcctttccccacaactcactgccctcctcccaacagaaaatctatttcgaggacagtatgctttttaaatgaataactaacattgtgttctcagctaactgcagaaccagaggagctgtttgcatctgtctatgcagattgagtttctttaatctcacaccaggcctccagccacatggaaacaaggcagttatctgcaaagctgaactagatctcatctctagtggactccacttccccctctcatatttatcccacaccagcctcatggttaagaaggaccgtcaggaatgtttttatcaactccaagctctaattcatattcctccaagtctctcaccccaccctcccaaccctgcccccaagatttcattgagatttctcccaacagttatttggaaaaaaggtaaaacaaaacatgttcaaggtcttggtgcttagcccaaggggctccatgtgctgggacactgatgggcaggggcttctgcctctctaacccatgcccaagccacctcctgacccctggctgcaaaagatgggaggggcagaagccatcacaggacttgtaactgcccaatgggctcaccttacccggtgcctagacagagctgatttatcaagacaggggacttgcaacagagaaagagtaaaattctcagagccggctgtgcggagacaggagttttattattcaaatcagttttgcccaagcattccaggatcagagattttaaggataatttggcgggtggaggaaggccagtgagtcaagagtgctgattggttggctggagatgaaaccatagggaactgaagctgtcctcttgcactgagtcagtcagttccagggtgagccacaagatcacatgagccagcttatcaatctgagtggtgccagctgatccatcaagcaaactatctcaagcactgatcttagaagaagtttagggagggtgagaatcttgtagcctcaggccgcatgactcctaaaccgtaatttctcatcttgtggctaatctgttagtcctacaaaggcattccagtccctaagcaagaaggaggtttgttttgggaaagggctgctatcgtctttgttttaaactatcaactataaactacgttcttcccaaagttggttcagcctacacccagtaataaacaaagacagcttggaggttagaggcaagatggagttggttaagtcagatctctttcattgtctcagttacaattttgcaatggcgatttcagacccagaggatcagcatctcaggatctggcagagccccgggcaggatcattcagcttggccacccgctggcttgctggtgatgagtgaggattttctgggcagatcctgtgtggtggggatgtggtcaccagtcatcaggttcttgtctggttgtgcacttggcagctgcttattctcctatttggctttggccatgttgtagtctcctgaggcaaagtactttttcccttttcggagtcccttcataaggaagctgggcccccaggcctttgtcctaggcttggatatttggcctttagcttttccttctccactgtctcagggagagtacattctttctcccgcatgccctgcttcttcttgcctgtctcctccacggtgttctcgtttagtttctgggacattgtgggactgggacaatagagtataggaggtccaggaagtcaaccaactgagaggtggggaggggaaacgggacatcctgcgatgctgctttggtccctgtcaatagggttgctcctcatcagtcatcttaagcagggcgtggtctaaacgaatcttcattccagatagctgaggcagaggcagggaggctggtaggagactgccgttgtgatctaagcaggaaatgatgaaatgatggcaaggctgaatccaagcagttctccaggacagaaggacactcagaagatatgtgactgcatggagatgggggacaaggcagggcagtgctttggatatggcccagtttccaagcttgtgaaactaagtgggttatgtcccattcactgagttaagaaggaacgaatgagtgtggggtggaagagaatgaagttttttcctgaatgtgtttgtgttggggtttgttataatgagtctcagggtctggggccatcaaagaagggatgatcatgttgcttctggagcataagagagaaaaacccaggttggatatttagatcattggaggaaaaaaataaaagggcaattacaacatcttgttagttaacctctcttgccccttgcctcctggtctgcagactgaattgtaatggctcctacctcaggcagtaataggacaaactgagataacaatatgtcagctatgaagaacacacctgtgcaatgtgcaatgactgctgcttattattaatattgttattaatttgttgaaggtggaagaagcacttagactattcatgtaatttatttctaaatttaaatttaaatgacagttcctagagctacttacagagactccagagagaacccaccttctcagaggttcccctgtcatcacccaaccaagtggacaaaaagctgttagagtcaccaagctgtttttttgtttgtttgtttgtttgtttacatcattgccggttagatggcatctttaatgtcagggcagactcacacataactaaggcagtgctataaggagtagaaataataactgaaaatgtgttatcaagcagtagatgagtctcaggattctgggaacatatggttggtattggtttgactttagagaaggtcacagaaaaaaagttttgtggactccccggtgataactgggggcctgggggagagaggcagtgaacatcatctggcccagaagggaatgttctgggtcacaggcagttcctgaggatacttggggatgtcactttgttcatgctgttctaaaagtcaaggtggatgttgggctgaacttttaggctgcattcacgtgattggggtagaacattttaacacattgccgtttgctctcattgagtcatgtgcatttgttcattcttagtctcttctctctatttcaaattatttcttcccacctgtttggaacaacatcagcattgcatattggcctcaaatgagttaagattcctaagttcctaactagccatagcacaaggtttttcagcttgactggtctcaaggcttttctcagaatccatcgattcttccagaaaactttgctcaggacatgcagattgcaataatttgttttccccaaaatgtattaagaattatttatttaaaaatataaaaacttcctctaaacagtttgagaatctcattgctgaaaatatataaaatgggtacacaattaatttctctccagatgtgatactataactagtaacttatttaaagttgaaagagaataatttgcatctggaggaaggtgttgtaaatgcaagttctggtcctttcatgttcctgatgtctttggaatttgtctttgtctttagagtagtgctgttttggactcagctccaatacagatgacttccacgctccccttggactgattaagtgaaaatgagagaatgaaataatattatccaggagattcacataccccaccaagccacgcagaatgtacttttaatacataggggtagtttagacacctcaagtctgtatggatacctcagggtttaattgggttttgtggtgatgccccaagagcttcatgccatttttagatatatttgttcaaaaacagatcaataattgatttagatgtgggaggtaaagatagatgcgcactaactgtggatgggctctgcagtgagaaggcagtgctggggctgctaatggtggctcaggtggatgcacactgaaggggaaggaccaggggatggggcgaggcattgctgtcattcgtcttgaacggaacagttgtttcattctgaaagtgcttgagaatatactctttggtgctttgagtttggctaatggttcatagtctcattgttctgatgaaatgacttcaaactcattgttgtcattattgagaaacaagttctctccaaataagtttgaggagacattctccaaggaaacaatctcttaaatgtgagatatttgtgaactttttccataaaatacagcagtgcccccttatttgtggtttttcttttcacagtttcagttgcctgaagtcaacttgagtccaaaaaatggcattactactcttgcactttggagccatggtgaggtaaaatacgggtgacttgaacacaagcaccatgataccatggcagtggctctgataaccaagacagctcctgaatgactaacagggctggtagcgtctacagtgtggatacactggacacagggacgattcacatctcggggagcaggatggcatgagatttcatcacactactcagaacagtgtgcaatttaaagcttatgacatgtttatttctgcagtttcccatttatttcacaaggcctacgtcatccacctcacttcatctcctcacgttggcacatcacaggaaaaagggtgagcacagtacaataaggtattttgagagagagagaccacattcacataacttttcttacggtgtattgttataattgttctattttattattaattgttgttaatctcttactgtgcctaatttatataaattaaactttatcttaggtatgtatgtatgggaataagcatggtgtatgaagagttcagtactatccttagtttcagatatccactggggatcttggaacatatccttcacagataaaggaactactgtagtgatatcaatgcgttaattctggaaaaatattacatttcagtcttggtgtcaaattctagcaaagaataatttttaggactatgagtaaaccaaggaccaacaatgaagtagattccatgtcactaggaatagaagttttggggatgtgtgttcatgttttcatatgacttgcacctgtctggaaacaaaactgtttctaattatttttaaataactagagttcaatctaatgtaaactatatacaaaagccagatagcaatcactaactttgttacatcataggcatagataattttaatgaaacatatccaccaagtatgtccaatttctctgatgacagtgctaacttacatgcgcatcaaacatttgataaatgaatatgttaatgactgtaatgtcttttctgggaatgcctttgttggggctcaacacattgttaaggagaagaaagcagatgactgagaggaggtttgtaaagtggggatggggagagtagctggaagccatgaacaaattcattctcagaggcacagatccccctacatgagctaggacctatgctaggagctagattcacagatatggggacgctatgggctttgccattcccaagcttcttgtccagtaaaaccacaactcagaaatcttgcttaactaagtttagcaagttatctgcctatctatctatctatctatctatctatctatctatctatcgatgtgtctatgtatctatgtatctatcatctatctgcctatctatctatgtgtctatctatcatctatctactgtctatctctagataaatatatagatatatacacataatgcatagtattcaatagtactatgtgaaaattatgttaaaggagatgtattagtcagggttctctagagggacaaaactaatggatacatatctatatatgaaggggagattattaaggataattgactcactcgatcacaaagtgaagtcccacaataggcggtctggaagctgaggaacaaggaagccaggagtggatcagtctgagtctcaaaacctcaaaagtagggaagccaacagtgcagccttcagtctatggccaaaggctcgagagcccctggcaaaccactggtataagtccaagggtccaacagccaaagaacttggagtctgatgtttgagggcaggaagcatgcagcagaggagaaaggtgagtgccagaagactcagcaagcctgctcattccactttctgcctgccttttctagccatgctggcaggcaattggatggtgcccacccacattgaaggtgggtcttcccctcccagtccactgactcaaatgttaaactcctctagcaacaccctcacagacacacccagaaataatactttgcatcctttaatccaatcaagttgacacttaatattaaccatcacaggagataaatccctggacttcaagagaacctattgtcaccaatcattttaggcatcatttcatatggtgagtagaactgtgctatatattatattatgtgcagaccggggttagaaagctatggcccacagactgaattaggcccactgactgtttttataagtaaagttttattgaaacacagccatgcccatttttaaaatataatgtctccagccgctttctgacaaatagtggcaaacaatgacagagttgagttgttacggtggaaacaacattctccaaagcctacaacattttctctctggccctttacagaaaaagtttgctgatttctggtataggacaatattatataatatgctttcattttaaacattgggcaccactggttaagtcttattttcttccaaacataacaactatatgaaatctaaccctacagagcccaggagcctacacaccactatttagttcttacacctcattgatataagtaatttttaatatcttgttattatttctagaagtctttttggtatggttctttccatatctagcagtttgtgatttttttactttaactgcaatatgtagcagtttgtgagggataaaataaaacccccttttccttctgtttaaatatatggaatgtcagcaaaagcctcctgttagcagtagctgaatctaagaaatgaaccttttatacattggcttacactattttgtccaaagccaaaaatggataatgaaggaggaaaatgacaaacgttctttcctaaagagaagcatccaagtgtagagaagaccacaagtgactataaaacgaggaagccccgtagctaagggattcacaggtaagcccaggacatgtggactgtggaaggccattaatgtgacatgctctgtggtattcagataccttgctgcatgctgggttcggctctagggaattaagaaaagaggaagatggatatggaaaggtcaatggcaatgggtaaagacatggaaaactatttctataaccgtaaaggagactgagttaatttatcttgaaaaataaaaaaggtaagaaatggcttgccgtaatttttctaccatttatatccattatgatacaaaaagtaaacacttgctggttgattgattaaaacatatgtaagatagagagtggcttagtaaaaggtattttagttgcaaagacagaaatacaagaactagtaagtctaacaatgtatctttatgactcttgaactccaacaaagactttaacagcaaggagttagaaaacttaggctgcacatgggtcttgggaatgattggaacaacgttcctagattctgtctggattctctttccagcaatacatgcaaactttcttctctctcctttcagtctgcccctctccttaccgctttgagcatggcagatgatagcttttgaaatttgtatcagttatccttggccacaaaaaaaaaaaaaaaaaaaaaaaaagacatatctcaaactctttttatgatcccagggaacagaaaatcctggggaaaagatgcccaacttgggtcaggcatctgctcttgggcgagtcaccttagtccagtgagtgaggccgtgtggtgatagtgataatatgctgcacctgcattaaccatacagatgaaggaaggaaaacttaatagccaagggaaaactggcagaaatttctaagtgaacactgcattatttctttttggaagaaatcttcactggaaaaaatccagaagaaatagctcagtctgcaacatgaaggatttaggttagaaaaaaatgagattattctgacattagagcttattacacactgggatatgttactgaaagaagcagtaaaatgtcttttcttagaggtttttaaaaatagaattcatttctcatcagttgagatgcaaatagttttcaaaatggattagacacacagaaattttgtttgacgtgcaaactcttgacaaggtcctgcctctttttgccagtaaattcagctcattctagccttttggtacaattcaacaaatatttattaaatgtccactaggtgcaaagcattaggctagagctaaaaggtttatattatgttatggagatttagaaaactgcaaatggggtgggcacgctggctcatgcctgtaatgccagcactttgggatgctgaggtgggcagatcacttgaggtcaggagtttgagaccagcttggccaatatggtgaaaccctgtttctactaaaaatacaaaaattagccaggcatggtggtgcatgcctgtagtcccagctactcaggaggctgaggcaggagaatctcttgaacccaggagatggaggttgcagtgagctgagattgtgccactgcactccagcctgggcaacagaacaagactccataccccacccccccaaaaaaaaattgcaaatgactgtaatatgtggatagttgaggccattgtcacaaaggagatttagatttattgctgtggaattctaaagcatgagagagagtcatgaaagagagaagaagagagagagatgctaacagagaaacaaggaaacacagaattagcaaagtgttagttgatagactgagatttgaaatgctctttggggtaaataggatttcagtaggtagagatgtgtgaaaaggcatttgggacagttacaagtttgtgaacagtgatttggatcatgttcagggaagcagagagtcattcttttaaatggaaacctatggtaccagcagggaagagataacagaaaagattaccaaaaaaaaaaaaaaaaaaaactgggaccatcctctagaaggccttaaatatgctgagtattaagttttgtttgttttgttttaggaagattagtatggtaatgtgaccacccaacaagttcttcctgccccactgcacaaataaagaccacggcattgcggtaaagaaagagtttaattgacgtgaggctggccatgccatacaggagaccaagttactactcatatcaatctcctggaagacttgtaggttaggggtttttcaaaggcagtttggggaagggggtgggtgtggctaaaatggatgcttgctgctgattggctggggcagagatgaaatcatagtgggttgaagctgtcctcttgagctgacttacttctgggtggggcaacagaagcaagagcaaggttggtgggggccaggtggagtcatgggtatcagacctgcaaaaaacctgggaaaatgtctcaaaaggccagtctacaatagtgatgttatctgtaggacagatcttgtgaccagtctatgccttagcagaattcctgcccttctcctagcctgatggcctttcattagctttacaaaggtgattgaattttggggaaagcctattatcatgtaaactataaactaaagttagcttagcctaagaccaggaatgattaagggaaaggcaagatggggggttaaatcagacttgcactgccgtaattttctcactgttataattcttgcaaagtcagttttagtacctctgtgagacatgtcatgccaaggaaagagcagaagttgggaagaagaatttgaaggtcattgcagaaacttatcctgagtcatttaactaggtggtggtagcagaaatggaaagaagaaactatatgggagggagatggtagggaaataacctacagggctgatggattaatgggttttatgtattgtgtactttcaaaacactaagcattaatcaaaaaatagaattctttaatttcctaattccttaaatactagacctttatttacatatacatttaagcctcatatcaaccaaataaataggtcagcctttatccccattttcatataagcaaacagatttagagctcttgaataattagctgaggccatattgctagcaatctgctaagtgggactctgaacccaggatgtctggctctattgctcatgttcttaactacacgcagctcttctctaattgaagtatagagggaaaaggatgagtgtgagaaaacaaggaagtttcaaccctggtggattgagaggtgttccagttatgcattggtacataatagactacccaagacctagtggcttaatacaacaaccattttgttgcagtccgtgattttgtctattagaaacttggacaggcttggctggagaagtctattatacaagacatggacaaaggacactcagtgccattcagctggcagatgggctagtctagaaggagcaagatagcttcattcccaggtctggcaccttggtggggatgactgaaagtctgggttcagctggaatgaaaaccagagccctgcatgtggcatcttcagcaactgggtctcaggcagtcagtggattatttttgcctgttttgggactttatgtaaatgaaatcatatggtgtgtattggtttctttgactcaatattatggttgtgaaagtcatccatgttgttacatgcagttgtacttcattttcattgcagtattctatcacattatgtaaatatactacattttaattattcattctactactaatggacatttgggtcattcccagtttgagctttaatgaatagggctggtatgaatactcttgtattcatactcttgtatattgggtgaaatatattcgcatttctgtggagttatattcctagcagtagaattgctgagttgcaggatatgcttctgttagctttaactattttctatactgtttttacaaatttgcactcttgccagcagtgtatgagaatttcagttgttccacatccactgttaatatcagaccttgttaattttagccattttagcttttctgacgcgactgttttgatgtagattgaccccaaatcagagtgagggcgtctctctcccactgcatcattctctgcttaactaactctctatgccttcccaagagattatgaaagacgcctgtctgattcttccatttaagtattttcttatcttatagaaatacgtgggatatttctcttaaaattctactgaagctttgaaagaaatggttcaaatggaccttacattcaaataacctctcctgatatttaatcagtgctctttccacatctttcagccaaataacattcacttgcctttgctgtatatgttcttatgtagaaataatagtctcaacatccatcacagtgcattacatgtgggaaatatacttccaggtgaaaacttgttgaattttggatattttgaggattttcagatttagttcaacctcatccaatatgtttcctttctaagtaacagacttaagagtaaatttgggctcagctgccaggaagtgaaagagaaaatgatctgtacatgcagatatggatgtagcagaagatgttttcctaaatcgcaaaatcaaaagaacgatgtctacacaggactcagaggaatgaatgctttgaagtaatttagcaatgtgggaatggtcaaacattttcttctgtaaaatctcctgctctctgccctttcattttttttccgttctcattctttttcttcccaggtctgtgataaggctagataacataaggaagtcacttggcaccgtgtccagcccatagtgcttccggtcctgcttttgatgatgacgatagaggagatagtagtatctccttctttaagatattttcaagtatgaaagtaactgagttagtgtatatgaagtatcttctagaaagtttgacatatagtgatcttcagagcagatgcagaggaagccagacaagagggataaataaagcaggcaagatgatatcgcaagagataagacaaaacttctgtgctctctgcatttgcctttccaagaagctggtagtttaactttccttgggctttctgcaaaaatgttgtgcatctgaacttgagcaattttgagtgtttctcttccttgcaaacaaatgagccttgacttgagcagtccctttagtaggcatgtcatacattatagtagtttttgtgaccctctcatctctccaactggattataaaatcctcaagggcagagatgtctctaatatgtctttgtattctgcctcgtacttagcacaggacgggagaaatgtcatgttatcctgctgattaagtccattaaggattcaggttgcataactctcctaatggggaatggagaataaattctgcaagtgagtttaatgttcacgaaaatcatcaacagcaaatgtagatgcatgccctttggccgtgcacaaaatgcaagggagagggtggtcttttcctaactctttgtgaattaccctcgctaagttctcacctcaggggcagaatgcaatttgttttttctcttatagattttttctcagccttggtgtgaagcctccaactgagttggaagatccaaactgggacagggaatttaaagaggggaccacaaaatcgattccaacagaactttaagtttaccccaggttagcttcatctgttgcacacagaggcatctgcttaacagatcattgtagatatgattgcaaattccacataaagggaatatttataggaaggtctgcctttctgaatacgtaactaaaaattagtttgttttgtaaaactgtactttaggccaaactctgattcactgtattaagagtcccaaactaaccaaatgagagggacatactagcaaagacatcttcatccacatgcgggagggaagagggatactgccaagttcttgcagaaggacagcacggtctctttcagctccttaaatatgttctgatgaggcacttcagtaaaacatgcccatctgcgtgttccactggactaatgaatatgaagtgtatgttcagctattgatctgaattaagtcctaggaccagaatttagtgtcattaatgatctctttaatgaacgcaggcagaaaccattatcaaatgatgattttttttttcatcttggaaagattattttaaatccaaacacattctttcaactctgttttaaccccccagagatatattttaaaagccattgtgagaaagtaaatgagaacattgtccaaagcctgggagtgaagcatttggtaggaactggaggtggggagaaggaatgttaaattcctctttcttgaaccattacagtactttttccttatttggtgcatgtctggagggacagggcttgggcaggggaatgccccttctactctgctgacaaaaagcaccaagagtggctggaaaaggctgtagagcactggtttccagattttgttgcaccttggaaccacttggagagctttaaaaaacactgatgtccagctcttacctgcagacattttgatttcactggtctagagggtgatctggacatggggattttgaaaacagtcagctgggcatggtggctcacgcctgtaatcccagcactttgggaggctgaggcaggtggattgcctgaagtcaggagttcgagaccagcctggccaacatagtgaaaccccgtctctactaaaaatacaaaaagttagctgggtgtagtgacgggtgcctgtaatcctagctactagggaggccgaggcaggagaatcacttgagcctgggaggtggaggttgcactgagctgagatcgtgccattgcactccagcctgggcaacaaaatgaaatttgagcttgagcgagtttgagcgaaactcttactcaaaaaaaaaataaataaataaaaataaaaataaagaataaaaataaaataaataaaaagagtcttggcttattctgaagacagtcttttaaagtggccaaatgaaaaataaatgactgtgtcaattcagtttattgtaaacatttactgagcacatactctgtataaagccatatgctatgctttagtaatgcaaacaaaatgtaaaatatatacctacccctgaggagctcacaagtttagcggcgaggggggccagttacatggacagataaatgcaatgaaattacaactcagttaaatacaaaacattgtgatatatacaaaatcaaaaattgtcccaaagtagtgcaaagtacagaaaaagagacaggaccaggaaataccttacagtgtaatttccagatataaaataacaaatgatcagtatttctgaaactttgagggccagaggaagaatgggttgtagcaaagaactctatcataagggattttctatgttgtaataacatgaggtttcataggaataaccagcatcttagaatggggtctgtcttagtaatagtctaatgtaaaacaacacgattatttatttatcttgcctgcctactttccgttctccttccttccctcctcccctgctgtcctcctttcctccctccttccctcctctccttcttccctctctcttttcctccttccttttctactctcttcctcccttccatccttctttcgttcccttctttctcccttcctccccttctttcttccttcctcccctccttccctctttccttccttctatctgttcatctccccatgttatacctacctacctacttcctacagaggcacctacaactttgcctttcattgtttaactgagttatagattgtgaagactagagtgacttaaccacccaccctcctttcaactgtgtggtttattacacatatgtatctcattgatgttttttgtggacattgcacttgtgtaatttattcttttctcatttgggtaaatatgaatgcattgaaataaagaggactagttttttttttatttcaaaattatatttaaaaggaaaaaataatgagacaacagcaagagtcactatttaactcaatttgctgtattcttaaaactggaccttacagtaagcactataagtaagaaaacagctactttccaatggagatataaataacaatgccagatgagctgttgctcttaaatcttacagtgggacttcattagtgtgacaagtgagaagtaacaaatttattcccagaaccagaaaatgccattcaggataagtgttttgattaattcatttttagagaggtagggctgttttaatcatgacaactcttatttgccataatagaagcatccgtgaattttttttttttctgaacacttcatgtgtatttaccattccactgtcatgatctggttattactaggactgggttgctattaataatcaacacattattttaaaattgaacaagctaatatcaccagcctgtaattttctgggtttacacattgaatctattaccataattaagttaatagtattttaaatgaatgtttattttttatggctttgtgtagcaaactacaattagatgtttgtctgcatacacatgttttaggagtgttcactctgtaaatggttttgtatgaatctattgtaagaaaaagttcaacctcttttgcatctccgatgagttagaattaagtgatactgctcctgtcaattcatttttttaaactcaaaagtttcactttatctgtttatgcctctttagtttgtctgtataccatgaacacatatccttcatctttccccaccttagtatccactaggttttttcctctctggttgcctatcattagtcaattgtttttcatgctaatcaaagagcagagaaaacaaacgatgagcatacaggtaaaatgacattcatgggtttcttagttctttggacactcagagaagagaataaaatagcagtttgaatcatttgtggttctgctgtatctgtaatccacccatttgacataatgtattattggagtggctaattggaagttcatagggtgtgtttccatatgcttattataaagaacagatgtaagagtcaatttcctgtttgaatggtgatttgagcactgagcaatttatttaatcagaaatgtctttattattcataaaactgttccagtctgatcccatgtgtttgtttcaattctgaatgtgactctctacccagggctgataaactctgttgttcacattaggatgttaaacagaaaaggtcacgcatctgatcccatgtggcctaattagtgtcaaacaaagaaaatgtctgtaaattgttataggctgcagtaccagaaacccacgttacttaccttatggggattaaaattgccacaaactctgtgccagaccatccccatggctgtggcaatggtactaaagccacattccattggtggtagagatggcagccaggagtaatgtgtcggatattgtcagttatcgctcagcatccattttcacctttttcaatgtgtcgtactgtgccacaggggcttgagggttaaaaatcaactttcctgactcctttgcagctagggttctagatgtaaatgatgttctgacaattagatgcacttgaatgagatttgaataaagttaaggcaaaggccatcttcttgctgctatttttgttggtgaagatggctgcagaaatgagtattttcaggtgtctgtggctgtcagacttggccttgtaagtgtctagaagcagttgtggcagcaacagcaatgccttcctgacctctgcttgcagcagctatagttttatgtccctgtactaatttgttcagagtgaggctcctgactcctgatctaccatgctgtctaggaattttgcagccagctaagctactgcattcaatcccattctacatgaaataccaggtttctgtttcctgcagtcaactttgactgatatgaaaatagtcataaccacataaatgaagagttatagtttactgagtatctattaaatgccagacaaattgaggatcagtgagataacttgtacaagttcataaagctaacgaatggcaaaaccagtgtttgagtttcggtccatctgtttgcaaagctagtacacaaagggcagaaactgtaatatgtccatttctattttcaatttttaaaaagaatgaaatcatgtcctctgcagcaacatggatgcagtcagaagccattattctaggcaaattagaacaggaatagaaagccaaatactgtatgttctctcctataagtgggagctaaacattgggtactcttggacataaagatgcaacaatagacattgaggctactagagggtgggtggagggagggaggggagcgagggttaaaaaactattgggtactgtgctcacaattgatgggaccactcataccctaagcctcagcatcctgcaatatacacatgtaacaaacctgtgcctgtgcctcctgattctaaaatagaagttgaaattattttttaaaaccccacattttagaaatccccaagggcagctgggcacggtggctcacacctgtaatcccagcgctttgggaggccgaggcaggcggatcacctgaagtcaggagtttgagaccagcctggccaacatggcaaaaccccatctcttctaaaaatacaaaaattagctgggcgtggtggtgcatgcttgtaatcccagctggtcagcaggctgaggcaggagaactgttcgagcccaaaaggcggaggttgcagtgagctgagattgtgccactgcactccatccagcctgggcgacagagcgaggctccctctcaaaagaaaaaaaaaaaaaaaagaaagaaaagaaaagaaaaaagaaaaggaaaaagaggaaaaaaaaaagaaatcccctagggctagggatatttggaaatccccaagggtttgtggttttctaaatttctattcaacattttagaaatccctaagggaaggagacttttgtatcctcaagtgcttgaggtctataacatcactgacaaaagaacacattctagaagaaccagatagaatatgtgcacccttgagactggaatagctgcatcattgaagcaagtccatatcagcttccacctccatggtaatacttgggatgcatagatgtagaatctagtctcagaagacaatgtgattctttagcccattcaatttgttcatccattattttttgtatgcatcatctcaaccctatagggggcagttaatgggttcggtttcatgtttcagatccccttgaccttgtttgtatgtatatcacagtgtttatatagtcagatctttcagggactgaagcaagccccgaaaagacaaagtgcatcattagctgggtttttcaggatttcgtggccagtgtaaaacaaaagtgggagagtgatagggcagaaagtgctctattatttctgttgtcaacaaagactcagttacctggactgagagcactgcccttcccagcctgcaggaagactcaacgccggggtcctatgatgcacaagtgagagaagggggatgttttgcctgagaaggtatgactctgggggccaagcaggaggggatgagctgtcacatgggagagatgcaggctaagaactaaaactaatgaatggaagttacagagaggtaagaaatttttttccaagaactgcctgggacaaacacagctactccaggaagccacttcactgctgaaggtgttttgtgcaaaggtgtgctggcagttaaagaggaatgctgcagataagattcagctccataaaagagtgtgaagatgtctctcatccctgaagtttataggatgctccccacaaagaactgcagatttcctttctaactcattgactggagctcagggacaccatgggttgaagctatggctctggagggaactagcctagacttacatcctggtcctgatatttacttgctgtattaattctgcacttcagtttctccgtctgtaaaacaggggaaagaacagtgtctctctcataggggtaagtgtgaaatcaaatcattcaacccatgtaaagtgaattgagcttcttattcctattggctatgtggtgattgacatcggagctcccaaacagttcaatgggagaaggttgcaaatgaattctgcactcagatgctcactcaaatgtcttgagaactaggagaacccaggggaccctgtgacaaattttcaacaccatttggtccagccaaagggttgtttcagactggctttctcagtgcttgagagagaatctaaatatttctcaaggcatgcattacaaaatgttcaagtagctgctctatttttgagaacatgcacataagacaggcccacaacattgggggatgttcgagaaaagaagggagaccgtgagcccaggtccaattagggatcagcaccttctgtgtccccgatctttacatggataatgaaggactggggagccgcggttgtgggctgataccatggcaacccctcttccatgattgtcacatacagatgagtgagtttttaatctcaacatcagtcctgaatctcattcattatttttaagccctaaaccagaaaataaatattgcttgtctttctgcctttgcctaataagtaactaaagtttacataaagacttggcttactttggttgtttctctgttgggtgtgtgatgtccaaatttaattaaaggccatgctgtcggctataaactcctttagtgagagaaaatgacaggaaggcccagaatttttttttacgaggcttgtgttgattgagttaaagcatgtgttctaactgagctcccttggaatgagccgtgcattgttccatgccacctggctgcaaaacaaacacaaggaatttggctctgacatgaagaaaccctcagtattagggaaatggagctgcattccacatggaagcatggcaacctcgggctctgttcctccccctttgccctctcaccagacccctgtgcatctctgttctttccaggagagggagaaataaaaaatatctcaatagaaatggaaaccagtgttgggtttttttgttttgttttgtttttctagcagggtacaccactcactcaaccataccaaatataagtgtgcgaggcttggaatgaagaaagaaatggttactttttaaaagctagcaatattaacaggtgaatgtcataggccatgagtctgaatgtgtcagaaaagaactgcaagtcattagacaagaccaatagtcctcctggagggaggcagtgaacctcaggactgtgggcactggcctgcctttgtcttgggtattgacttgctgagtggcctctaggaacttaattaagttcctggattcctcttttgacaaatccagattacaaacaataaccaccatggccagtgctcttgaattcatatgatagtagagcattataaaatcagaattctacttaagagctgataattatgtaggagagaagagcatgctgactggggcaaaggggccaggtggttaacttttcacggttcaagagttgataaaaagcatatgaattacaggccagtgagaaggacatttttatgattatttggaaatttttgactccatccggaacagagttgaaatattcaggtccgcagggtgtgagtagacagttggcttatgatctcagcagtcaggatgtgtcatttctgtttcctaaaaggctcccgataaatgctttctggaaggtgccagtgaaagacatttggaatttaacagagacagcaacagcaggttcggggcttatctcgggctgcattgtagatcaatcctgggcacagtggaaggaacactgttacaaaagagccatttctaagaaggcttcacttcaaaggagatcacccacagcagaggagctgatgcagagctgaataaataatgaaaaatacaataaagatcaaatctgatagggatttgaattatatgccaggaaaatatttttgatgaaaatgaaatggtagggagggttagagacagattgaagaattcataatcagaactgctcacgacctgcatcgcttagtcctgtacaattttgaggctccatgagaaggcagttagtgaaaaatatatcagtcttttctctgaaattcgaggtcatccttatcttgagactgcccgggagttcctactccctactctcctcagcccccactgtagtgcaggaaaactctggccctgatggagccatttgcaaagatgttacggaagaagctgctgtggccacccctgcagagccaggcacagatctaggacttcaaggcagatagttcctgttcatagtagaccagccagagccagcttttgggtatctctccagccctgaagtatctctccatcaccaatgatgggtatctctccatcagcagtgatccccaagaggtgatgtccttcctggccttcagccatgtttgttcagtgggacctcaagcctctttcctaccactgatgggtttgggatatagaccatgagaaaagagagtggggggaaagagaaaaggaaagaaacaaagagaagaagagaaggaggaaggggagaggaaagagagaggagagagatgtaggagaaaggagagaaaaaggacagggagagaaggagagaaagagagagaggcagaaaaggagagagaggggatgagagaaagaaggagaaagaaagagggggtgagagagaaggagagagaaaggggatgatagagagaaggagagagaaaaggggtgagagaagaagagagaaagggggcgtgagagaaggtgagagaaaaaaggagataaaaggatagagggagagagaaaaggggatagagagggagaaatgataaaagagagaaaaagagatgtgaggaagggagagagaaaaacaggaaaagagaaaaagatggtgagggagaacacatgctagaataaggcagatacagatgaaatgagaaatagtgaaagagtgagacagtgagggggaaataaaggaaaaggagagaggatagagagagaagtggatagcgagagagagagagatggtgatggagactgagacaaagacggtgagacccaggtacagacgcagagtgacaagagttgggaagaggccagagggggccaaacgtgatgcttgggtggcctctctgctcttgagaggatattggcagtgtctccagccctgtgcacatgtcccactgccatagcaaatccagaggctccgctctgctgtggttctatctgccgttacacaaactatgaggcagccctgcccatgcagagaacatagtcatgtggcctttcttgttttatcatcccttcactctttcttacaggctctcccccatcctcagcttctgtttgaaggacctgcaaattattcttgaaggacagatgtgatgctgtgctgggaactgctcttctcctcaaactctggcctgtttccttttcatgaagcctgggagcctctattctccctttttatgatggttctttttcaggaggtttctgagtcccaccagcaaacagacccgggtgggctatcctgccaggctgacagtgagacagagatggacccacaagggcccctgctgcctcgtctgccatcccacagcttacccgccagctgggcttattggaagctttcctttaaatttcactgtctcacattccagaccttcctcatttccttgggccagtgggctcaatgccctggtagctgggctgtctccctcttacatatgcacattattttacaaagaagcaatctagccagagcaggtatattgaaaatagagtttattggagttgctgattgtggatgcttgcagagggctctttcttatttttctaaaagttgcattgcttcagttgcgaatcaaggtcccttgatcaccatgcctcctcttgcctcatgctcagtttttcttattcttttcttctctttcatccaactgctttctccagacttcaactcttatatctaagcactttgggcctttggtgctgttttgaggcagactaactagagtagaattcactggcattaaaacagtagatccagcaaagtctggtggaaataaatagtgtagattagtggaaggaatatgaggaattggtaaaagattcatgcctctatggaggacatgctttgctgaatttctggagaatccgtggtcttctctagaattgtgtgtctttcatcatcacccagagagacaagcttttttgctcttcatggaatctggtatataatgcaacagagctccattattagtggagaagatgtacagacaaaaataaaaacaggggcagcgtgcattttggtagggtcttctatttcatcctaacacacaagcgtcttacacctctttgccttttcccaaaaggcatatatgttttagaggcaattccagtgagtaaattattcatctgaagacaaggaagatatagaatagttagagttttattataatttttttatactgcaagggagatttttctttgtctcctaaccaaaaatagcccagctattgccaaatgaaaatttcttccacatatccttctcttgccaaaacccttaataaaattttgtttaaaaaatcagtgtgaaccatgaaacagtaaaactcattctaatgtatgaaaacatgtatatactgcaaagtcttcttcttttccaagtggcctgaaggtggctttgctgcaaacagtgccttttgggcataagaagccctaagaatccagagacagttgagaaaacctattttctttcctgtctactcagtatttggggaagacaaaaaatgagaacataaagaaaggcaagctccccaagcttacaaaagattccatctctggtgatcctgtgagccacaaaataatagaagttttgaaatcagtgtagctcatttctagacaatggaggggattgtggcaatagttcagcatctgtcctcggttatttctgaaaggatagatagtatcgtagaaaaacaatccatacaggaacgcttgaacaaacaattacaagcatcataaagcaagcaggtctggaatcgatcccagcaaccatttcccattctcactcttctttaactttgcctgttaggtggttttcgaattcaaccttctgtgagtgtttttaatggtacactatcaattaccccaggtaaggaatgtctatgcccggttctctctcaataaagcaaaatatcacatcattaagtagttttcctctctgatttgtggttagagtaacctaaagagggagggaagtagggaactgtgtacctgtcatgaacacacacacacacacacacacacacacacacacacacacacacgtgtgcatgcaagaaaaacaaacaaaaataatacataaataaaaataatcttttctttgctagaacatttctccctggagtaactgctgaggagaatctctatcctgtcttctgtgtgtgtttgtgtgtgtgtatgtgtgtgtgtatgtgtgcacactctgctctgccttcacgttcctctctgagcacactgtacgtctcctgccacatgcatacacacgggacattctgtctggactcatgggacaagattacttgcatgccaactcactgcctcaggagacttcctgtttatattcaaccacgcatgggcccttataaagtcataattcttgccaccaattgaacatcttgttggaatatttatccactttgctttagctggaaaacaagtttttccatattgcaagaaataagtgcagtaacttgatggtgtttaattgcactaattttggatttgggggtgacctggattatacagatcctacttccatgatgtatatttatgggtacctcttccaccagctgttcaacgttctctacaacctgacctgcttacatgttaatctcaccttctaccctcaaccttgttccccatgctgtagcctggaaggcttatttggataccatactaatcatcttcccacttcagcatcctccaacttaccctcttcgtcacctggactgttcttccttcaaaatctgtatctgactcatttcttatcattctgatgtcattgaaatgtcatttccttaaagagactttctttgaccactataatgtcctctccttcattctactttcaacagcataaccccatttaattttcttctatcagatttcagtctctgtcagattgacttatgtcattgcacgtttgtcatcagtctcttttatggaatatggtttgtttgtggtctgagccttatagtcttattcacctgtgtgttctcaatgccaaggagaaggtttgaaacagagtagatatgataaatatttaatgaatgaatgaatttataaatacacaaaaccaaatcgtgtgctaaccactttatcaagctaaacttgataaatcactacaaaaatcttattggggaggtaccattattatatttgccttgttagaacttaggtttggctgcatgtgacagaaaatctcaaagtagaggcttaaaattagatggacatttatgtttcattcatataaaagcattttgggtgttccagatgtcatctgctctaccatcctcacggtcttaagatggccactaggggtccagccatcacttctgtttctagacaagaggatggaggtgggaataaaaaaggataatgcctctctccctttaagttccatgatagtcctcgcaatgtgtctcattggccattatttagacatataccatacctacttataagctggaaaacataactcagggcaggaatgtgcttacccaaaacaaaaacaagatcttgttcctaagaaggaaaggaaccagccctctacactgcatccccattgactctcacagagagaaagtgactctggcaaagtcacacagctaatatagcatacagtgctgagatagaaaccctaacatcgttacatccccaccacctccagcatctaaacctcccccacttacccagtaatatagtacacagagaatcatccctctctgcagggatctttggtagactgtggagccaaggttgaagcttctttcttcatagtccccaaatccagggagaatcctagtaattgtcagatgggcctgcatagagtctgcattcacccttcccctcctcagcctcactcagcaacctctttccttctgttttcttacataaattctcttttgtcttaacagtactaatgacaataatacttctttctatcgagaatttacttctattcactatgcactctatggttttatttttataagaattagtttatacagttctcacaagcagctaaatgaggttaagtaattatttaactcatttgaaagatgggtgatctatcagacctaaagaggttaagtaattttttatttttttgacatgaagtttcactcatgttgcctaggctggagtacaatggcacggtctcggctcagtgcaacctccgcctcccaggctcaagtgattctcttgcctcagcctcccaagtagctgggattacagttgcccaccactatgcctggctaatttttgtatttttagtagagacggagtttcaccatgttggtgaggctggtctcgaacccctgacctaggtgatccacctgcctcagcctcccaaagtgttgggattacaggcgtgagctaccacgcccagcctaagtaatttttttcaagtaaatccagaatttgactccaaagttcaccttacaagccttctccaattcaaacaccaccttgcctttaatgtcttcatcaccatgtttaaagcacattctcgtgactcaaaataaatgattgtctctgagctgaaggggaatgatgtcttattttacctgaaccacagatcagttgctgcaccggaatggtggacagttgcctcctcctagcgtgaaattacagtcaatgacccagaggcaagagggtccccatatcatcacagagccctgagactctcaatctctgtagggatgaatgtggaatttttctgttgcttctgtgtttccgtaactgtttacatactgtgtcatgttaatgcattctgccataccatttttctccaattatctgagcttttgcaggaactctgaggtagtgagacatacattgaagatgttccaaagaaatgaatggaggagttttctctgcaaatcctttttctctgaaaaactcggaaaagctcactgcctcatcttgcatgtgagcactccactctgaattctgaaaagcagcaaaagagaaaacagaatctggcagaggagagatgaatattacagaaattgtattttaaaagatattgttatcggggtaaaataggtgggaagaaacctcatgagttccctaagaaaatatctttcaaaagttaaaaagatactcttacttatagtaagtaagctggaaccaatacagcaaggctgtgtaaatatataatatgtggtattaaggacaggctgaatgcatggctaggcctttatttttaagaaatgtgtatttaatgcattgcacttgctccttcagctttgttacactctgttggattaagaggtaacttagcaggcaagctaatttgaaatcacatacacatgcgatataaatggtagacatggctttcagaagtattatttgctgttcacaaatccatattatgcaaatatcaaaagaatgactggtattctcttgtagtcaacattttttaaattgtactggttccacactgcctcaacagctcctgcttctttttctcggggtttcttttgtgattcacagtggactgtctcactgttctgagctgataggatcctattattatttacttcttcctttcaacacacccctgaggcagttcaaaggtgaattcaccattattaggtattaattcacagcaaaaacacaggcttatcatttttaaaatctgttgtcaggactcacactggttttacaatatcaccttgtcacaacaagaactaaaccttctgatgagccccaagcctgaatttctcaccatcataaatagtatggggacatatttaacatttattgatagagaatggctaaaatgtattaaggtggaaatttgtgctgaaaagtcttcgtattttagttcctttaatccttaaaacaatcttgggagctacgtgttattttatgactcctattttacaaaaagtcaactgaggcttggagaaattctctggttaaggttacatagtgatatggttaggctttgtgtctccacccaaatctcatcttgaattgtaatccccataatccatatagtccgcacgtatcgagggagagaccaggtggaggtaattggatcatgggggcagttcccccatgcttttatgatagtgagtgtgttctcatgagatctgatggttttagaaggggctcttctcccttcgattggcacttctctttcctgcagccttgtgaaaaaggtgccttgcttctccttcgccgtccaccatgattgttaagtttcatgaggcctccccagccatgctgaactgtgagtcagttaaacctctttcctttgtaaattactcagtgtcaggcagttctttacagtagcgtgaaaacggactaatacacacagcacagacatagtgcagccttatttggaacccagactgtttggctccagaatccatactgtgtgtccttcacctgaccatattgcatctcattctgtggtatcgtttacttaatcatttattcattcacccattactttttccaccataaaagttctaaatgaatgcgtactctttgccaaatgcaatacagaacagtcggtgagaatataggaaaagggaagtagcagcgatgctatggaatcttagagttctcctctcccagcctgggagtacaaatgtcatagaattatttatggaagagttgtcagctaagtagacaccaaaaggttaaggagaaattacctagatagactgggaagaagaaatgacaggtggaagaaacagcctgggcaaaagcacaggggcaggaaacaaagatggtatgtatgaagagttacaaacagcttggttctattacggcataaacatgagacaagagaggaagtcatagagttagcaaagggctgaaggatctgccatgctaaggagtcagcaatccccacattaggatgcacaaaatgatccactgagacacaagaagaaaatattaaagtttgtctttatatttctctttgatactgttttttctttccgtttttggtaaagctttaaaatatgtatagcatacaaatgcaataacagaggaaatataattcttgtgggaaaagtatgtgctaaaattattttactgatagggtctggatgaatataagtttgcaggtcactaccgtaagtaatggagagacaatagatgatttttttttttttttgagatggagtcttgctctgtcacccaggcgagagtgcagtggtgcaatcttggctcactgcaacctcagcctcccaggttcaagtgattctcctgcctcagtctcccaagtagctggaactacaggcgtgcaccaccgcatcggctaatttttgtatttttagtagagatggggtctcaccatgttggccaggctgttctcaaactcctgacctcaagtaatctgcccgccttggcctcctaacccaaagtgctgggattacaggcatgagccactgtgcccagaggacaacagacaattttaactgaaggctttcttggcgtatgcatgtgtctatagattgttctcaaaacactgtaatggatgacggcagaggtgtaacactcagggagggaagtgcactgaggagattgctgccaccagggaatttaatgttgatgaagatagaagccaaggctgtggaaataagagaaagtaatagattaaaataatttttaggtggttaacttaatagggctggtgatagattggccatgatatttaagaagcatcatctcactctacatgagctccagccacaagccttcttgctatcacttgaataagtccaatacaggactccacaggaccttgggcctcctttttctgctcctggaatgctttccttcatctttgcctggctggcctcctcatttatttctcatctctgtggcaatgtccattcttatcattgtggccttccctgaccatgttatacaattcctcaatacttcctatcaaccttagtgagctccatggcatacacatctgagaaattctgaaatcacttctttgttgtataatagtgtaacattagggactttgtcatttgtgttcattgctctttctcacgcgacagtgtttgacacataaaatgtgctcattaaataaaggagcaaatagatacatagatgaacaggtagatggatgggtggatggatggtggatggatggatggatggatggatggatgggtgaaagagtgactcttattaaacttatcccttaatgagaccattagagagatggaatgtttccactgagagatgagaaaaaggatgtcctaaacagattagaaacttgtctaaatttatcctatctgttaaaactctttacttagtctataaagaggaaaccaaataaaaatggcttatgtaatagaggaaatttattgactcaggtcactggatagtccagaagtagaacagcctcagaatagcttgttttagaagctgaagaatgtatctggaactggatctgtttctttctttctttgcttttttcttttctcctcccctccccttccctccccttccctcccctcccctccccttccctcccctcccctcccttcccttcccttcctctttctttcttttctttctttctctctttctctttctccttctttttcctttcttctttctttccttctttctttctttctttctttctttctttctttctttcttctttttcagtgttcaaacattttattaaatcggatagcattgttatttccacattgttgcacatactgacttgtattcaattataagagtatagcacatgtttacaaaggtatggctgagcagtcagttggtaagtttaaaatttcaagagcgctccaagagcaaacacagtaaagaccatgcaagttccagagtcgtgaattatgacagagctcactcattttattccttgcctgcagttgttccaaatctcatagcctcaactctcactgtccagacacagagaaaacatctgtttccaaaatcccattgaaagtcctaagctttgccttacttggggccacttctgagtgactcacagaagtcattaggttgctatgtggcaattagtttaggcctgcgatttcttaaccaatctctgtgtcaagaaagatagtaccactctgattggcttagacaaattagggtctactttttgaggaggggatctttggggaggaagccacaatgtcctttataggcttggaaaaaaatctgggtgtgtattattgcaaagccatttaagactgtgtgtttctttatcaagaatgctttccataacccaaagatgtcacatatacaaaatttgagcagaagatttgcttctaaaatagtttcatatcttttgtaattcttaattatggtatacataaatagacttacttcttccccattggatgctatgaaacatacccatgactatttaaaaataataattcactattaaatttagataacaaatgttaatattgtaagacaatagcttcccttaaattctagttctctctgcttacttgatgtgactatcagtagataaagggtcatgatttggatctggggaaggacttgctgcttctggtttgtataaaggaattaagtagggaatgtgtaggaaatctggctgggctcagcaatgccagctttaatggaatccaaacaggttttcttaaaaataaatggtcatgagaaagctgaacgtcaacctcctttcctgttgataaatgacaatgtataccagattgtatcaacagttccgtggagcaggacacccctctgcttttgagtctctgaaaaaaaattatgctgctttccagcaactgatctcctttttctccatactaccgcctttctttgtcatttctctcacacttttgttatcttctttaattgcagtatattctttcgcttggcaaacacacatacagcaaagtcaatccaaagtgcttctgatttgagcaagttccttgctctaggctcacctgaaaatgaccatctgtgttcaggtcatagaacttataaatatacatttaattttttttctgttttccactcactttttataaaataaaggaaaacaaatttcacagtgttgtctaaagactgttcagcagttctgttcatgatactgcctatctgcaccactgatgttggatagcacaatttttttttgtttttcaatgaattaaaatacaacctagtatgcaaaagatgctaaaataggagaaacaaggcatataacatgtgaaacctgagaaccccttgcgcttgccattccacaccttttcagaagactgaaaactctacattattgaccatgttggtgtcatcagcacacctgacaatgatcttcttatccttatggaactggacatcctagcctttctatctgctcttggcataatctcttctcttagagggtactgtttattactttttgaaattgaagtgaatacaaattatttttgcttggagaatatctttgagaacttcatgacaccctttgaaaatttgaaaatggttgggtttttggtttgttccagaggccatatttggtaaacaccaacttctgaggcaaacaacatttctgcacagctggccccagaggcggtccttgtgccaaatccacccatgcaatggttgatgccaaagagttcagaaacacaaatccaatttaattctggctcaaaaaagcaataagtgtttaaattggatttctgtggagtttgttcttattaagcacagcacgcaaactgctttataggcatttattatttagttatttctaacaaaggatcttatagatccagcatctataattaatcgggaatgagagtagatgctagccaacatatgctctgtgacccagaacttgcactaggaaagctatcaggtttgtaccaaacaccagggtcgttggcaaaagtttgcttcattaaattcggctttgtgggttttatgcttttaatccaggctctcagctctgtctgtcagccttacctgtatcatattaaacttaacagggtcaatatgatgcaaagaggtggcacctggaaagtggtgtatcagtgactccgctttcaatccaatcatcctcccattatgtcttgtcatctttcaactccagtggtcctgaggcttcttccaggcacctccactcgagattattcctggatatgtgctcacccccatgtggcccatgctccataatgatgggtcccatctcgatctctataaatttccttttctgttgaagcactaatgaaaagataatttcataaatggttatgggaatggcttacttggttctcggttgctttttatcttttcctaattactttgcattttagtaagagccttccagaaacagagcctaaataaaccagggttgtaatggtggagatggcagccccatgaagctaatgagatagttggagtcagacttattgcgtggccatgggaggtctggctctgcttacctacattttatacttggcccagaaccttgctcacagcatttgataagcaacccattgttctgattcctagacactgatgtcagaaacaagcactcacctgctagtgttgatcacatactccatgattatttatcaaaaaaggccttttctttatgagactgttgttcagtaggccctttatagtcacaaaggataattctcataagctttaataaattccaaatatgagtttagaaatgttagtgctagttctggcttttcttggtttctatttccaatgagagtcatgtgctttcaatgcatatattcacattacaagttaattcttttcatctttcacactaagcttttgtattttgtttagtgtattttttttatttcacaggagaacagaaaagtttactttgccacagtcagtaatatagaaaagatcgaaaagagaataaagaaagtgttctaagaagtggctgctgtgtggatgactaggttcactaactagctgggtgacttatttctatgtcagccttgcagtggacactattaacatttgggcatctgcaaaattataccttactacatcatggattttcagattaataatcaagatgtaaactcataagtgctaaaagtgtgaatgccacaagtctattttattgactttgacttttgtggtttcctagctctttttttttttacatagttgccttgagtaattcatctactccctttctgccctagttttctcattcataaaataagtataacagtacatacaaatgctgtcttccacagggttggttgttatgggaattaaatatgttaatatgagtaaaatgcatagaaaaatgcacagaagtcttactgttgtaacactaaagctacaactaatattactgctataattattgcattattgttaattggcctgataattgcattatctcattttgtataatgttgggcgaggaattcattcaagtaggaaagatctaaaagataatacattagaaaagacaaaagtaaaacaagtacaaatttctaatttctcctctaggccctacacactcttcaaatcctaaacttttggacttctatctcttacacctaaagtgaaccttctagaggtaattgccatctgcatagttagacatgtccaaaacagattagcactctctttatttgtgcacataaattgctatgtcttttattcaataaataatttttggtcacttattcatgacatcgtggatgatacaaagatgagaagcacatgatttctattatcagagagaaagaagaaaaatatatggacatgtgactaaagtcaaacgtgccatgtcaacaagtatgggcagaatcagctgtcgtgcagtagatgaatattttggctatatgcaagatcagtggagcatcaatcactcagtctgaatgtgcagcaattagattcagttaggttaatctgttactggattccaccattccaacatctggttggctcagtcataaaagtgtttattatctccgtaagtcagtctaaactcatagtaggctgccacttggagcttctgcagtgataggacaccagcattctttccctcagtggcctatgactgctgttggtcaggtgtctacagtgacttcaagatgattccacatccttgaatcatttctcaacacttaccagtgcactgggttgttgggatataaacacaggaacccacaaacaagacatcctctttctgggactgactataaatccctatcccgtattcatactggaaaactggtaagaccttgtaaccctcagcattcttttgctatctgagaattaggggctggaatttaggccagctcttttctaggctttcttgatttttccactccaatggaagaaaagcagaggaggaagcaagcaggaagacatggaaaagaggacaagatctatgtccctccgactagggcagagtttggataagcatcccattccagccctattctctggttaccttgcgcttttcatggttgacaggatgggaaccctcccaaacagcaggctgcgccggccctaacttatgtgaccggttgtaaaggagaaaaggctaaatcaatagggttataaaagcacataccatgcagaagttcagagaaagcaacaaggaagaacctgaaaagtcaagagcatcaccattatcagagaagtttcacttctaaccccatttacttagcatactgagctccacctttaccatagtgacctcctggtaagtgggtgccaggagctccccctagagtttaaaatgtgccattgtcaatacctcttaacagcctgggggaaaatgcttgtctggcaggcataaggcccagaggagatgggagttcagaagtctacgtattaggttggtgcaaaagtaattgcggcttttgccattcattttgcaccaagctaatacacaattacaagccaaagtagatatctctccctcttccctaagcacccctccacttgaagtgattttgcccacaccacatttgaacaaactcaaactgcccccttcaaaatgatgggatgggggagtggggaaatggttaagtctgtcagctaagctgtcccagagttctcagagtcagaatggagacgattgctttggtatctgtttgatggcacacaaggaagaaaaggcagctacacatctttctcttgccctttggcagcagatcacaaatgtcacagcttgggagggtgccaattagtgccccttgtatcctaaataacctgccacagaaataaaataccaagcagtccttgctttgtccttgtgagttggggcccatgctttcccccatatagagtatctaattttgaaaatgtcactgtagatatcggcacacagtgattctacagctggagagatgaaggtggaggccgcatatgatttgagtcaccatgcttctccacggactgcactaagtctcgtctataggactcaagttaggtagcagttcatagaaatggcatgaggtcagataaagtaaacgatttcaatcacacttgaaaaatacaatgtgtgtgtgtgtatgtgtgtgcgtgtgtgtgttgtgtgtatgtatgtgtgtgtgtgtaaaacacattctcaaaaagggggtgatagtataatacttagatgtgaaaaaggacaactctgataattgtagaaaattaccttggtatgtgcatatataccttttgaaaatagagatgtttaggcattttatattcattttttagagttccacttttttttttttttttttaacattctcttctctttctctgttgatttaccgatagaatatgtgtgtgtcaggacacttggcaagatagagacagctggaagtaatagagccaagctctgtttgaaaagctgaattttcacaagtggtttggggtttaggtgtggggagcagaaatcctgggcttcggaataacttttgaaaagttgctcccttgacgtaaagatttgaaagaagtaattcacagcctgccttgcactttttaaaagttgtgtaacattacgccacctaccacaaaagaaaaaatgtatataggaaaagacacgtcaacattatttcgaatgatgtatttttaatgtcataactttctattattatttaatctgtcaaggaaaacatatactggaaacatttgagaatcctccctccctgccacctttgcaacacacacatgtccacacgcacttttctttgccaaaagtaagaagctggggtctggaaggcttgctcctgaatatggtgtatatcttatgtaaataaaacagagcatgcagctcaaaaagaggaaagtagtttgtttttccatctttgatttctgctgttgtggctcctctttgttacgaattaagtctttaccatcatttagtgaaatgttatcctcgtaatggtaacctggattgttaccaagttacttttacagacaccatctccatttctccagtgatctagtaactccgtggtggatttaactcccctattgtttttggcttatacacatgagtctgtctaatgcaagctgtgtttttctgggggccgaataaaaagtcttcatgagtgatagtgctggggttgcagtattgaaacatactattgggatccgttttctgattttgactcagtagcctgtcagaggcagaatgcttctccttttgataacagggctaactagtttctgaaggaatgcataaaagagtcaggctgtatgaattccagagtcttaaattcctttagctatgccctgcaatctttaagcaggaaatataaacatgtaccagctataaaatgtgtgagaacaataataggaatggctatctttcttgcatctctcaagtgtgacatacagaggagagctgtatcttattactaaccttgtccatcaagctaatatttgtatattgcttttctagggcctaatggctgagccctatctctgaatattggataaaggagcaattagaatcgtttgtgccaaaccccagagttggaactgcaggcccttttaatatgagtccaataaggaaaggtttagtgtaaatgaaggtcagctgtcttgaggtccctgaccaaagctctgtgtgaaagctaaacagagccggagggagtttttttcacctggctataggctaaatgcaacacagccctatagcatgcagatgctcccaaataactaacttattttcacaaggaattataaagcataggaaaattaataaattaaacatagctccagtcctgcccccaagaatagattgcactactaagttttggcaaaagtaagaagagaccataaaagtattagaaaaaaaaagaaggaataatttattaaaagtttctattttttaagtaagtatatgataaaaataaagatgtttccaatttgatttctaaatctttgactcttcaattgcttggtttccatgcttggcatggaaagaagaaaggaaaggagaaagaaggaaggaaagaagaattgcaggcaagtaagaatgaaaaaaggtaaggacaggaagaaggaagaaagaaggcagaaggaataaatgaatgaatatgcctgaatggccacatggaaaatttaaaaattatccaatgctgagtaaaaatcaatgacagccagtaaacaagcacataagcacactcccctaataatccgtcaaataggatgtttttaaatcacagcaatatttgttatttcttctgatgctttctatttgttccaagccttagagcataaggctagctactaaagagcagaaagagaaatcgaattcggctacctgttgttgctggtatggggagggagatgaataaaagcagttccaagctccagtggctggttttcatgaaaatgtattttcttaaatcaataccatttcagactggttagtttttggacatcctttaccaaagatagatagataaataaataaatgagaggtcattttatatttcctttatgaaataaatatgcttaaactctaatggtaaaaatgtatgtgaagatcaaaatttatattgtgcttaatgattaaatgggctacagaaaaatatttttacctagtagacagcatcttagtctcaaactcaggctctatttaacagtcttaataattagcttcaggctgggcgtggtggctcacgcctgtaatcccagcactttgggaggccaaggcaggcagatcagctgaggtcaggagtttgagaccagcctggccaacatggtgaaaccccatgtctactaaaaatacaaaattagctgtgcgtggtggcacatgcctgtaataccccgctacttgtgaggctgaggcaggagaatcgcttgaacccaggaggcagatgttaccgtgagccgagactgagccattgcactccagcctgggcaacaagagctaaactccatttcaaaaaataataataataattagttttgtaccctcagatagtcaagagcaatcagatttttcttaacctttattttctcctttgtcaaagggagctaatagcagagcttgttgccttgagattaataattaaataataattcattaataattaaaaacagtaaaataatacttgaaaacgcttttttaaaaaatatagacaaaacaaaagcttttttcttttctctctctctctttttttttttttttaacttgaatatcaagctcgctatgcaatttgacttatggagtgctgcgggaaacctgttggatattttcatgtatgtccttaaacacatgactgctttccttgtatgtgcttgattcttgtcagtccttctcctcgttattgaaagcatagattgctggctgtgagttggaatcatccactggataacaaaggcagtatctgttttctgggcctcattgtttgcaggtctgtgtgtggtccagcctagaggtttctcttcagagatctatgattggcggtaagagagaagtgaggttggtcaggagggtcaaaacaatgaggaattgcatggatgacccatagacagaccagtggtcatcgtgtcagaatctccctgcagcagcttcctccatcaccgactgagcagggctacccaacccactagccccctacgggcttatttacatgatctgatttccaaagaaactttcttttccagatgttgtgtgctttgcaaggctcagctctgtgggagctctgcttgacaaactctaatatagtctacatgctcacaaggatggtttttgctaaagagaccccagtgatatgttggtgcaattcaggatttctcagggtagcacatcaccaaagtgcctgcaacaatactgtcaagatcttactgattcttctagccagaagagactaaaacaggtgatccaagactcactcaagcatgcttcgtttcttaagacatatagtaacatagttgcttttaatttttaaattttaaggattaaatccaaatttgatcttaggtaaatatgtaaaatctagtctaataggttttgggaggatggaatatagtgagatataatgttcattggataccaataccatatttatttcccactgtatatgatgtcagaaaccgttttaaaatgcagctggtctaagtggaatgttcaggtcttggtttgtaggtatatgataccttggttatttccatttatttttaagatcttattgtctgtgtgcatgcctgccttctgcagacacaaatcaaaagcttgcaagatagcacagctttttttttttttttttttttttttttttgtctcttgatagaattaggacaaagatctgtacatggaatagacctgaggctgggcaaggtcttcctccgcctatctcaccatctttgtctttgctctgtgccctacccaaacccaccttcttttagttcttcaaatactccatacctgcatcaaccagaagttttttgttgcttcccatgtcgtcttgaccacctagaatgcttgtcacctggttgcctcctgcttctcctgcagttattatctggtaatgtctggagatatttttgtttttcacattagggggtaagacactactcaaatcttgtgggtagaggccaggtgtcttagtccattttgtgttgctacaaagaatacctgaggctgggtaatttataaagaaaagaggtttgtatggctcacagtttggcaggctctacaagaggcagggcaccagcaaatgctcagcctcagatgagggcttttgtgctgaatcaaaatgtgatggagaaggttacaggggaaacagacatatgagggaggccttccttaactttctgatgagataaaagtcctctgttataggctcttactgcaacagttcctgtctgtcactgctgtcattagaattgcagttttactttgctcgagtaatatattgattactgtctaccacccccaccagattgaaagtttcatgaaggtagagtctgtatctagtttgggtcttcattgtatccccagaacttcatacagtcacataaaagtgatcacttggtaaatatttattaagtgaatgatggaatgagtgaataattgaagaaataaaggcataatgggaggagagaacaaaaaagaagtcaggcaagctaccaaagtgatgtgcttattgattgactaattttcaaaccagttcacatccatcacaagtttgttcatctatttacttggaaagaatagatggaaactgaagcttgaaaaaaagtaatcatcgagactgttttcatttgacatgtgttaatttcagcaacccctttttcttcaataattcctctgttgagaaagtttggtgatggtatccatgcacatcatttttttttcactgaagctcactgacacctggaaagccacgtagtttttcagatttatttagaaaatagaaagcatctttaaaagtccttcaaaagcacaacagcaggattttggtgtcagtaatcatatgccatatttcaggcttttaatttcctcggaatggtatttcttatgatctgaaagcttttttccctcccctgcatcagatcttattttaacatactgattgagcctctttatcttacacttcctgctgggaaaatagatgctaaaatgtgtgtaatgtcacatttactttaaggcatcaccagataaaattgcaggacccacaggcatgaactgtggtgtgcatgtgtgggatttcttttcctacaactccagatctccatcagcagctcaagccaaacattcagacccttcaacgttatgtttaattggatttcattctttttctttttattaaaagcctttagtttgtaaatttttttcactttgtactgaagcttttagaaaagagcaacctcttttttcaaaacaaagttttgatctaatcatttgcatctgttttgtactaattttctttgcagatgtttcggagtttgagctatgcagttaatagaatgacaccagattccaactggtctcttactatttgtgagacctcactgttttcaagggtttaaaccagtgattcttaactaggagtgattttacctttcaggggacatctagtaatgtctggagatatttttgtttgtcacattagggggtaaggcaactactcaaatcttgtgggtagaggccaggtgtcttagtccagtttgtgttgctacaaagaatacctgaagctgggtaatttataaagaaaagaggtttgtatggctcacagcttggcaggctctacaagaggcagggcaccagcaaatgctcagcctctgatgaaggcttttgtgctgaatcaaaacatgatggagaaggttacaggggaagcaggcatatgaaaagaagggaaaacctgaaggtgccctgactttccaacaacccactctcaagggaatgaattcattaccaccaaaactcatccaatctctcgagagtgaaaagtcattcactactgtagaacactgtcaagccattcacgagggaacagtcctaaaagcccaaacacatcccagtaggacccacttttctacactgcggtactgggggtaaaatttcaatatgaactttactgggaacaaacaaaccatatcaaaactatagcaccagggatgcttctaagcatcctacaatttacagggcagtacccacatcaaaaaattgtctgccctggaatggcaatagtgtcaaggatgaaaaactctggcttaaactcaaccttaggcttccactctgtaaaattaaggtgtaatcacgtgcatcatagcaatgttgtaaagatgaggtaaaataatgcatcccacattcgtagtgtagtcagtaactcatgagccattgttatgaatatggttgcattattaagccctttacgatctggtccttaatcacctttctagatttaccttttccaattttctcttatatcctcagggacctcttaaaatttaccacttgttacccattcttatctggctaacttcccactctttacccacgctgaagttggatgtctccctgaaaccaatagactaatctgaaactaacccaaagactcatctaattttctggtttaccccatttcagagcccagttcccactgcactgaaattgtctgtttattatttttcagagtgtgatcaccacaccttgtgttaaaattaccaatactaaaatgccctttcctggactttattcaagatctactgtatcagtatccccgggcacggggtctggaaatatgggcatttagctcctgaattcattggtagctatactaaagtcatcactgtagatcctgagtttcaggctgggattaggtctttttttttctttgcatccttggtgcttagcattgtgactggcacatagtaggcacttcataagtaatagcactatttgaaaggataaatgaataataaacaaaaacttttattctactcttgtctcttattttgaaaagataaagacccattggtattagcattcagaggggagaaaatgctacttcttctgctctgttcttatatattcttatatacaagcatgctaaggacaagatatgcctttgtttagcaaagtttgaaagtgagaatcattagactgatcaaagaccaaagtcatgttttgtttggcttgtacaagctcagagagggttttttttttttctgtctgttgtggttgttttttcaagcttttaattgttttaagttttgaattagtggccaatattttcatataaaaatatgaaaatattgcagttggtatgttgatgagtggggccttatggggaagaaaaaggcacattggtattagcattcagagtgggaaaatgctacttgttctcttttgttcttgtaattcttttatacaagtgacttctgtcgcttaaataagtcctcgaatgtttacatgatcaaaaataacttatttttgcctattaatgtatggtttataaatacagatgcttaaaggggttatagaaagaaaggtaaaggaatagaagtcagctggctgtaagacaaaccagccaaactggtgagctcatgttctcttatagaaaggatgctgcttctctgatcagtaaatggttgctggttgaatggggaaatggatgaatgagatctcagcaatgccagatgtttctgtttctcaagagaagtcagaatttgatttttttttttttttttttttgagacagagtcttgctctgtcacccgcgctgtactgcagtggtgtgatctcagctcactgtgacctccgactctggggtcaagcgattcttgtgcctcagcctcctgagtagctgggactacaggcatgcaccaccatgcttggctaattttttgtatttttagtagagaaagggtttcaccatgttgcctaggctggtcttgaactcctgatttaaagtgatctgcccacctcggcctcccaaagtactgggaatataggcatgagccatcgtgcctcgcctgaatttgaattttttatgtgaaaatattggccactatttcaaaacttaaaacaattaaaaacttggaaaaaaaccacaacagacagaaaaaaaaaaccgtgtctgggcttgtactagccaaacaaaatatgactgtggtcttttatcagtctaatgatgcctactttcaaaattgctaaacaaaggcatatcttatccatagcatgcttgtaaatgagaatatataggaacagaacagaacgagtagcattttctcccctctgaatgctaataccaatgggcctttttcttccccacataaggccccactcatcaacataccaactgcaaaaacagaagtcgggcaaaagcagtgcgtgttgcttctatgtgagctgaagtttaatcacagtggtgtgtataatgatagctccacaggtgtccttgtctctggaaatcttggctgtgaccctgtaagatgtaactcacagtctgcaatgagaaacggggaataaatcagttggtcagtctctctgtatgataaatcatgagtgtgatgctttggcaatttagatcagcattaaactctgggactaaattaaagaaatcaccttcagcttgagtctgcacctagattaagtagttgtaactttctaataaatgtggcaagagttctgtgaagattcagacaagtctcactttgttaagaaaataggggggatggaaagcaaaggaggaactgaaatatttgggaagaattgaaccaccaagggtttagattaaatgatcaaagacagaagagcaagtgtgatatcctgagtgagcagagtacatatattttctttaatgggatgtagtttaagcagcataaaatatttatttcttgtagtaggtaattgagatccctaaattggggcaattactttgaatttagtcagtgtatcaatcagctatttttgcgtaacacccccctaatcatcagaggcttaaagctccaatcatttattttgacttacatgtctggggctggctggggttggctgacctagtctggccttgcctcaatagctccacctcaaaacgtgtgtccatctgggtttggctcctcactgcgagttgtgctcaggtctgatcctcatatgcttggtctggaacctcaggctgaggagcaacagctggccagaagttgctcttttttcatggtgttgacagaagtacaagagacacgcacagtggcacaagtgcagacccagcctctgcttggatcatgtcagctatcatcccagtgggttcagctaacctcagggtcaaacccaaagtcagggtgtggggaggtatactccaccttcagtgggaggaaccacaaagccacaaggtaaagatacagaatacatgaaagtggtgaataattgctgggcagtaattcaacttattgcactgttatgatagggcatccgtggatgattgtatgggttctgtggagatggcattatctagttggattgcataatgataaaaggtaattaggcagtgctaggcagatgccaaaggttcacacagagactttctccttgatataatttgaagtcttgattgagaagtgaaaagggagatggctaggtttgctggcctagtgctgtctgttttgcttctaaatgattgttgaacatttgaattaatgttaatttggtcaagcttcatcaaatgtctgtatgccagttgtgagtcttcttctaaaggaattattgtgccccctactttcatttgttttaaaagcctcatcactaaacttatggtcggcagtatattgtagtcggtaccttggttgacgtgcgtggattcctatcttcaacaaataatatggtaataagaggatataactcaccccttacatgtaaactacctatatccacacaaaattgtctttcattctctgagaaaccacaggactggccatgtcaatctgaggagcatcctagggaatttgcaagaggacctggagaagcagggctgcaatgtgagggtcacaatagaaactaatcaattgagtttcactccatctgcagaggatggtcagcaaggagtcagaatttgtctgtgcttcttcaaccccatcctaaatcaagcagaacatatatttcagtctccagagaggagaaaagaggccatgggaaggaagatggtgcatcaagccatacttgaagcttgaagtgtcccattcccttatcctgctttcatgtgcatgaagcaaccttggtgttcttgtttatacatatgagacttattctctaagcatccccacttctgggtgccccaagaaactgacaatccacagtccagcctgtggtgaccctcctaaaatcatgccgcctggtgaagctctgcctgttttatgatctgacgtcccagatcttcatctttattttgtttctcttggagatatgcttgatatttcatgctgtagagaaaatagtaaaaaaaaaaagtgttagttaaattaaaagagtataaagataaatggaaaattaaatgagtagccttgtaattaacaaggtagttaaattatgttttaaatgaattcttatctgctgccatctgatttcttaagaccttcataaaattggtccatagcaataacattacttgactggaagtttcagaacacagagtggcatatatcccaaaaacgcaaataatgtgaaactgagtgttagacatctcttatttaaagaaaaacatctcccaaccctccggcaactctagagaggaggagatatctaaatgactaatcaatcaattaagttatctcttccatcttctattcaatgtgatccaatcttccccctttagctcagctttacccttcagcagcctgccctagggtcttttttttgcacacatgattattgtcaggatacttttctaaacaaagactcattttctccctgtggaggaattctgatgccaaatgttaagaaaattgtttgaccctaataaaaatttatgtattttttttctaaccctgttcattattgatttcagtttattctgaacactgaattttttaatgtatcaaaagtgtgttgttacctaggtcagcctgtgtggtcactcagtcaatacatgagttttaattcaattcaataaatattttccatgtgcaaggcactgagatcaagcactgggcatattaactgtaaattagatttagtgcttgccctcaagaagattacagtctagtggaggaccagcacccctgcacaaccacagagtgccacgagccatgtcagaagaaccccctgcattggtaaagaagcacgcccacctttacagttgagtatttctcatgggggaagggatattttccccaatttattataaaaaatttcaaacattaagaaaaattgaagaaatagtgcagtgaacagatatgttccccacctggattcaataattgaaatttgctgtatttttgttttctttttctatctatctatcaatttactgatctatcaatctatctatcatctatctgtctgatatagtttggatatttgtccccacccaaatctcatgttggattgtaatccccaaagctggaggtggggcctggtgggaggtgttttggccatcagggtggatccctcatggcctggtgctgttttaatgatagtgagttcttgtgagatctggtcatttaaaagtgtgtggcacttcttccccactttctctcttgcttgctcctgctttctccatatgatgtgcacgctcccgcttcaccttccgctgtgagtaaaatctccctgaggcctccccagaggccaagtgatgtcgctgctaggcttcctatacagcctgcagaaccacgagccaattaaaccccttctctttagaaagtacccagtctcaggtatttctttatttcaatgcaagaatgacctaatacactatctatgtatctatgtatctatgtatctatctatgtatctatctatctatctatctatctatgaaagcaaattggagaaattatgacaattcatcccaaatgcttcaacttgcatctccaaagaatatagacattctgctgcacaaccatagtatcattattatacccccaaaatggacaaaaattacatatcatctaatacccagccatatttgaattccctcaattaatcctcccacctgttacggctctttactgttgttactgttgttgaaaccaatcatagattaagcactaaatttgtttttatgtcccttcagtttctttcaatatagaacagtgtcctgctttggtaaagtactatattttgaatttttctgattattttcttaaagagctgtataacatttttctttaagtcttctatttcttgtaaactacaagttccatcttgaggtgtgattagattcaggttgaatatttttggctagaaaaattcataagtgaggcaggcacggtggctcacaccgtgagtgtgtaatctcagcagtttgggaggctgaggtgggtaggtcacctgaggtcaggagttcaagaccagcctggccaacttggtgaaatcctctctctactgaaagtacaaaaattagctgggcatggtggcaggtgtctgtaatcccagctactcgggaggctgaggcaggagaatcacttgaacccaggaggccgaggttgcagtcagccaagattgtgccattgcactccagcatgggcgacagagcgagactctgtctaaaaaaaatataaaataaaaaaatgctgggcacggtggctcatacctgtaatcaatcccagcattttgggaggccaaggcaggcagatcacctgaggtcgggggttcaagaccagcctgaccaacatggagaaactccatctctactaaaaatacaaaaattagccaggcgtgatggcacatgcctgtaatcccagctacttgggaggctgagacaggagaatggcttgaacctgggaggcggagcttgcagtgagccgaggtcatgccactgcactccagcctgggcgacagagtgagactctgtctgaaaaataaaataaaaaataaaaatcataggtgatgctgcgcatttcattcacatcaagaggttcccattgttatttgtggtgccatgtttggtcacctggttttgatgtttgtcgcaaaattatctcgattatgaagatacattttctccctcgttttcaattagtaagtgatctgtgagttgacactggcgtcattgcctagcttgcttacccaaacctgaagcttgtattatccattgatgagccttttctaaatcactccagtagggttagcaaaatggtgattctctaattctatcattccttctacatagattaactagtaggctcctgtaaataactttcattttttaatatgcttacagaaagaaggtgtatttgagtggagcatgacctagaaatagcaaatatctagctacacataaacgttaaaaacccaagaacaggaaagaaatttagagaaactagagcatttagagctagaagggacctaaaacaatatatactccaaccttttaacaagtgaaaaaagtgaagtccaactatgttgtttatttttatctcataactaactagcttgatgtaacagatctttgaataaaaggaaacacattgtacacgggtgcaatgaggtcaaagtacgaatataattaccactgatttgttgacaacattgtttgctgcattataattttataggataataggagattgcttattccagcctcagtaagcattattgcacacatgaaatgtgcagggtataagtttttatatttttccttcattatgtgattgccaaggctttatttctaatgctaagatattttcactgggtttaaactgagccgacttatgtaccctggttctttcctactcttgaaactgtcagtaatgtcacagtgtctcatagctggaaatgtagtaaccacatcactccccccaactcctgctccctgatttttcattaggatgcagtttattaatccaagtaaaaatatgaaagcctcctatgattaggtttaagcctaatatatgatcctccttcctggaagggcactttgagctggtcattagggaatggagagaacgggtatcattagggaatttgcctggcaagagcaaggccaagactggaaggaaaattggattttatttgccaaagccgaggtaatgtcctaaataaaaatttccccaaccaggaagacctaagaaaattgtcaagaggtagagtttagaaccaggggcacaaagggcaggtgggagaataggctgggggaagactggagtgctaccaacaactagctttatgttttcctttataaacacgtattgagcacctactatgtgacaggcatggtgctgtgtgttttgtgtgcattacctaatgtaatcctcacaacagcctagaagtcagtacttttattaccctcattttagagatgcaaaactgaggcaacttacctatggtcaccctgttaataagtgttggggtgtccctgacccctgcacttttaatcagtaggtaatatgtagtacctttctctggcttgtaaatgttttcttgcagagaaaatgggaagcaactatctagattggaaaggttaaaacgaaggaatcggaaagcaacagttaaatagagttaaatggctacttttccctctcagagttttggaatacctatgagctttcagccataaagccaagaaggttctggctggcacgacattgtccccgactaatgctaggatggtgttgtcaaacagaggcagaaacagagccctatcctgtttctgctcagttgcccatttcagtctccgtcctgatgcaacacgaacttctacagacagactcagggtctccagaaagcaaagcctttaggaattaaagtcatctttgcttttaaatacttgtttctcccatgttaaggacacttttctaggcaaaaacctcctgattgcctgttgctgtggcatatcttcacaaattcatttttcataaatgtcccaaatacatctgagacattttttataacttgtgtaagcttccagagacaaatgttaaagatgacagtttggaaatgaagacacataaaacatgccttgggaaatagaaatcctagggcagcgacctcaaattcagtcctctgttcctttttagtcaatatattgaatatcatattcatatatatcatatcaacatcatatgtatcgaatatcattgtatgctgcaagtctaaagaaagagagactagaagtgaagaggtcaaggtttcagccatccatggacctgtgaaggcttgactttgaaatagtcacatgatcactttggctattagttttatcacttctcttatcttggtctgaagatctgagctgtgttttatgataaagaaaaatgtataagctagtttttgctgtataacaaaacaacttaatcacttaaaacagtaacaatttaatgtagctcatgatctggtatgggctggctcagctgatctctgcctgggctctatcatgcaatggttgtcagccagtcccttagctggctgctgggtaatccaggatagcatcagctctacattatggatttggctgagcacgttgtttctcctctgtttggcctcttctctccagcagtgctcagacttattcatgtggtacctcagttcctaaaacagcaagatggcaagccccaatcctctttgcaagcttttactttcatcacgtttgctaatgagccattgactcaggaaagacatggccagatttaagagatgagggaatatatcccacctgttggtggaaagatctctgacaccacatggcaaagataagaatgtaaggggtggggggattatggccgtttttatcgtctcccatggaaaggaaattcactggctctgaacagtgctaatcaaaattgttactgaacatcataaagaacgtgaggagaggcctctactatgcattatgttcatagaatccttaatggaaaaaagtttgaaaatactgactacttggtgtctagagccccctccagctttagtatcctgtgactaagaaatatcacttgtccaccaagtgacatctagagactcttcatcaataatatgagatggaatcatgggaacatgtgtttgaacacaacaccttgtggatcaggttctctgcttcacagcggaatgcttatgcttagaatttttgagtgctaacaagtgaggttgagtctgtgagctgcttgtctcaaaactagattctgaaaatttgcagccactgctacagtcttggcttgtagttttacattgaattattggactgaattatttcattttgtcctggcgtgccttatcaactgaaaatattgtcccagagagggagcacaacaatattttgtaaagaaatcattcctgcagagatgtaaagactggttagtaacctgagtctctgacccactgtagcaaacagacacacaggatgctgagaaggatccaggactcactaagctgcttaactcaaaaggaaatagtaaggtttacactggcgacatgaagctgagtctcctttgggtctggagtagattttggtctgtgcttatgaatcgtctctgcacagatgaaataatagacattttaatgactgttcatatttataattatattagctttggatccaggttagaaattcttcattcctcctgtcaagaacttgcataaccctgaatggtgattagtaatgctagttaagcatgctagttcattttcaaaatctgttctattttacacacacacacacacacacacacacacacacacacacgtagagtcattcattcactcattcattcatttgataggaagttaagtggcatgtagtagacatctgttgtttgtttttgtcaccccaaatctgtttgcttttctcctgacaacaccattctgactttcttttggggaacatacccttgctcccattctcactccaggttcttcagatggggtgagttcatgggtgggcatgtgactcagcctcggccaattcacacgacatattctcctggccatggtggtgcatcagaggtggcaaactctcaagccaaagccagtgacatgcgaaagaactttcactgagactgttgagacagaggccgtctgccctttcctgctgattataacttggaagaagaaagccctggagatcttggccactgatatggtttagctgtgtccccacccaaatctcatcttgaattgtagctcccacaattctcacatgtcgtgggaggggcccggtggtaggtaattgaatgatgggtctttgccatgctgttcttgtgacagtgaataggtctcatgagatctgatgattttataaaggtgagttccctgcacaagttctctttttgcctgtcaccatgtaagacatgccttttaccttctgccatgattgtgaggcctccccagccacgtggaaccatgagtccattaaacctctttcttttatgaattacccagtcttgtgtatgtctttattaacagtgtgtaaacagactaatagagccaccatctctctaccacatggagctccagaatgaacctgatgtataggaaattaagaaagaggggaagatatgggatccttctgacatttgattctaacccccaccctgaccttttcagatacaggagtctatatattgtcttttattttcttaagacagcttaagttttctggaacttgcttctgaacattctgttacgtcatttttaaatacttgccaattatttttattagttactcatcagggagggaaatcaaaccagctcctgtaaaaagaatggaatttcaactatccagagtctcaaatctaaaaataggtggctaactcatgtcagaagtatgaaccctcagttccactaaatcccaatcttcataagtggaagcccaagaatctctattaaaaaattttaaaagcttgctagtttatgatgtatcctgcttagcacctgttcatggtctatgtcccagagatattttgaatatcacatgtaaaggggaaaggaaataggatatatttttcactttctgtaggccagatattttttgaagtacttcagcatattttcatgtaagatatttaagaaaaacttttgcatgcatttcctcagtgttctaggtataatactttagattactggttgctcagtagggaggaaaaaaaaaaaaaacagccctgatctcaaggagcttatagtctatcgcatccaatagaaatttctgcccttaaatgttccacgtctgccctgtccagtacattaaccatggctattgggtatgagaaatgtggctagtgagaaatggatttttaaattgtattaatttgagtagccatatgtggcttgtggctaccgtattgaaatgtaaaggagtgtacatctaggttatttcttcttaaacttgcatgtgcgtatgaatcatctatagatcctgtgaacctatagatctgatttagtaggatttggtgttggggtggtggttctgcgtttctaacaatctcagaagtggctgatccatggaccacaccgagtagcaaaaataatcatcaaagtaaaaaagttaattacaaaatatggtaagaccatagtggggacaagatgctataagggagaacggaaggggaagaggggaagggtttgcgactcaatttaaactaggaggggaattatagaaggcctcactggagagggggccctggagttgcagcctgcaggatgcagatgagctagttaggatacagaggtgaggggaggcagtgcgacagggagcagcagtgggtgcgaaggcatctcaaccacttttatgaaagaatctgtgaaataggcgagtcatcaataatagaattatcattacatttagaagccccttactaagccattcttctccttgacctccctgacaggttcaggtaggtgcccttctcagtccccataactcaaggcatattttcccataatcattaacaccttgagttgaaatgtgccctctatcagtctctgctgcccactgaactgtgaacccttaatgtcattttattctctgcatcctcgcatggtaggcattttacacatatttgtcaaactgtagccaaaaagtgtgtttgtgtgtgtgtgtctatgtgtgtgtgtgttgtgtgtgtgtgtgtgtgtgtgtgtttatgaggtatcagggataaaagaagtagatatactgcatatatagatgtatgcattatttttctcctaaagagatgagaaatatttttggagttgagccaagccattcatggcctctccattacttttagttttatggcagaggattgctctggttttgacaagcactaattaattccatctctggggaataatgggaaatgcaggcttatgctgtttgcaccaaggttatcagttatattggttttaatgttctgccctgctctagatataaaacatgcagcaaaatgcacagccacctcctcattagctgtaaacagtgtatttcagatttgtcaagcatacatatttatttttacatccaagcatttttatttatcttccttgcaagtccatgaagtttttgccaataaattaggaatgcagtaactagttctgaaaactatggcacacaggaaattttattgatctcataatttactggatcttttggttaattacaagttctgtctagcttagtacactttttgagccagctgcgcatcataaatatgtaacctcagtactcaccctccctacattgctgacagcctcccatgaggtcaaaggtgtaatagctacaatacccagagcctctaacatgtttaattaaactattaatctacttttatctgtgacactagaaagccagctacattgaattttcagagttcttcaatgcatttgcttacggtaaatttttccaagccatatctttaacagtttagcgctggcaacccttttaaaggcattttgaaaaattgtgaatgttggaggaattaccatatcagctaataagaaaatgtatcatttataatgattcatgaatttgagtctaaatgcagtatatgactaaggcactttattaaaaaaagagaagacaggtttgctaaaggtttgaaaattgtagtagatcaatcagcagcagcctcagaagtaccattattttaaaattgtgtggatgatcattagaagagaagtcatctttgttacataaccttcaggaacttgctgaggacaagtgtaacctcttgtggcagtgatgacattttcagtgatcaggccagcttttgtgttcattaacacaacagagcctcaaaactttagttttgagaaacctgtgtatccatgaagctttaattaggttaacaaggtacccattagtctatctcctttcttgtgtatcaaatggcagtaatctactacagatgttatacaatgaaggaagcaatttgctgcttttcattttatttcctgtactcactcatgagcttgtggatatagaattatgtgaaaaattcaagattctatttttattcatgttaagctcatcttacctgtttgtacaattttttgctctttctttattaaaggaatctgcatcttatgtgcctccataaaagctgtaaaaatatgacaccacgaccttctaactaaagtacctggctttaattttaacaatgattaacagtgatttgagtcatgcatttgaacattccacttaaaagtcaatttagacaggcaatgcccatgcaaatattgattataaacccactgtgtttctagcaagctagattaatatcatgggctaaaattcaaaaatctatttttcttttctacttcattaaagagtataaccaaaaaccacatctatttgcagattggtcatatattttgcaaatgcctgtgggactgaaatttaatttactcaacatatcttccctcccaccctacctccagtcaaaatcatcaaaaccagaactcttgttacatttatggggcagttgaaactgtatatttcactttgttttattgcactttaactttttgcactgtattagctgtgagtattccatggatcttgttaaatgtgagcagcttccttgaaaacaagtcatttcaatggacatgttttggcttatgttcagtattttacagccaatgtatcagagccataagtttataattttaaatgccgcagatcttacttattcatcatgattagatgtttctatctgctattctattgaatggcaagctctaatactgataaataaagagagccagttcctgatttggcaacaacaacaacacgtactgaagaaaataaatgcgttgggttcatctccttgatggggatgcaatctaagtcaaatttttgaatgaccactaactatttgcataatataacatataaattgatgactttgggatatttatatcatcctggtgcctcaaggttaaaattagtagtgtgaaaagataattactagctatgttaaataaaatgagtttctagaatgcatttttatgcaatttgtgagtacagagctattaaaggctgtagttttgttttggagaataagttgtctctttggactattgtagtaatctctttgtaaatgtttaatttttatcctagataagcaagatcttttgggctctctttcctactgttctgggatgaaagcatctaggaaatttagagggcaactccaatgagactgtctggctcacagaaatgaatcaacgatagaaactcgggcatgcggtggtggggggaagtggggtggaggtttgtgttaggggagtggcctatcagctttgacatgtgtggccatcacttatgcagtctccccatgaaggcaggtccaggtagctctgcagcagagctggggcaccgtgcctgctctcccaggcagagcctttggtgactactgctactaccaggaatagctgtggatagagaagagaacactggccactgtgtgggtgaccagaatcccagcccatacctcagtttcattgtcttctatggcacttcaaacccaaccctcaggaaaaccaaccaaccaaccaaccaaccaaccaaccaaccaaccaaccaaatacatccttaggagaaggatcagaactaacaatactgaaactttgagattttcgtttttaccttataaaaatgtattttggccaggcgcggtggctcacacctgtaatcccagcacttggggaggccgaggcaggtggatcatgaggtcaagagattgaggccatcctggccaacatggtaaaccccatctctactaaaaatacaaaattagccaagcatggtggtgggcacctgtaatcccagctactcgggaggctgaagcaggagaatgacttgaacccaggaggtggaggttgcagtgagccaagatcacgccactgcactccagcctggcaacagaaccagactccatctgaaaaaaaaaatgtatttcaagttactgcatactcatagctatatatttcacctgagatttacctggttaaataacttgcctgagaacacacaagtagtaaattatagacttaagatttgaaattgaattagtgtgtaaaccaaagtccatatctaagctgggtgcagtggctcacatttgtaatcccaacaactcaggaggctgaagcaggaggatcctttgagcctaggagtttgaggctacagtgagcaatgatggtgccactgcactccagcctggacaacagagcaaggccccatcttttttttttttttgagacggagtctcgctctgtagcccaggctggagtgcagtggcatgatctcggctcactgcaagctctgcctcccgggttcacgccattctcctgcctcagcctcccgagtagctgggactacaggcgcccgccaccatgcctggctaattttttgtatttttagtagagacgaggtttcgttatgttagccaggatggtctcaatctcctgacctcgtgatccgcctggcaaggccctatctttaaaaaaataaataaataaaatgtaaaaagcctatgcctagttcactatataatgatcctatccatggtaaggaaacacctttcatgattatcagggcatcctttatgagcctaactgagagagagaaaggaaggtatggcaggatgggagtgtagtgggcacagtggtgtgttgggaaactgataatctaaaataagcaataaagcaaacagcataatgagctctgatttggagtgttttcctattttctatgacaggaatattcccatcatggccaatttcaagcttccaaagtgaggtcattgaatgtggagttgaaaagagattgcacaggctgggtgcggtggctcacgcctgtaatcccagcactttgggaggctgaggcaggcagatcacctgaggtcaggaattcgagaccagcctagtcagcatggtgaaaccccatctctactaaaaatacaaaaattagctgggtgtagtggcacatgtctatagtcctggctgcttgggaggctaaggcaggagaatcgctggaacctgggaggtggaggttgcagtgagctgagatcatgtcactgcactccagcctgggtgacagagtaagactccatctcaaaaaaaaaaaaaaaaagagatgcacagaatcagctcagacgaactggcttccacatgccactgagcagggagcacacatgtggccaagggaaagaagggtgaggggtggtcagggaaggagtgcattgctcatagcaggtgcaccaggcaaaggacactcaaggaccccaactcccttgcctttactgtggcagctagctgccttggtggcccccatgaactgcaccccccaaggttcatgccctatgcagttttatccccttgggctgagcctgtgacttgcttaaaccaacagaatgtggcagaagtgatgctgtgcaggttctggagctcagccttaaggtggtgtagcagcttctgatttagcactctcagagctttgagctgccctgtgagaagcctatctaccctgctgcaacagaccatgtggaaagaccacacagagggaccatgcaaagaagcagaggccctgacatcacatagaggagagtcaaggagtccatccattggaggaaaattggggctccagacagatgaccctcggagagccatcccagcagaggcaccacacttgggagcaaagagcccaccttgaggattcctgctgtgcatcatctgaattccagacctgcagaaatgtgagaaaataaaatgttgttttaagccactgcattttgggacaatttattaagcagatattgacaactgaaattattcttttttaaccaatgcaggaatcttatttttacttaacctatgatgttttatggtcagagtggaaagggaagccctgcccctgaagtcatggatgcaccatggaacccgtggggacagtcaaggtcaagtcctccaagtaactggcatgctattccctgcttcctgtgccttcctcctggtctcataaaaaaagtgcatgagaatatcatgggtgatggctttagcattggatatcaccatttccctttgcagtgacggtgtttccaattgaccaaaagggaaaaattaggtagagagcaaagagttctctacatgattgttcaagaaacagaaataaagtatcaagtctgtaagcccagggttctttggagtagtatcattcttaccttggtgacagtttggtgaggattttactgctgcttccttctcctctcatcaactaaacaagaaactatgaagtccctttcctcaaggaaagggactgtcctgatagaatacccgacctatatcatgacttgttggaatattgtgaaagcacaaaattgagagaaaaataaagttatccaatgtttagatgctgaattacactgttgtgtaaccttgattggccactacctgtgaggtgagacactggagttagccattgtgaattcaggagtcagtaaacatccagaggtgtgaagcctgctgcaggcctccagttcccccagaaaacagtatctggttttaatgattttatcagagttgttttcaaggtcagtaagtttgttgatattttggtcatgagattagtgcgaaccaaccacatattggcatttaaatgactagggagataagatgagtgatgatatcataacaatagaacatattgatgatttcagagcagtaaaaaggctgaaaatggggcaatgatacttatattaaagacaaaataggaggaaactttcagcctttgaaaaattttcatttgaataaaactcatcacatgatactccccagtgtaccacaaaggagcatgtacattctgctgtccatttttaggagaaagaaaagtcataaactcaggctgccacctcagttcaatacagttgcaatgtaatgtttgaagacgctctcaagtctttgggaatgaagtgaaaacgtccactccaatcttcttaccaaggtacaggcaagtgtacacttgggtcttgtactctacgtttaaagctcaaatttacttgggtcttgtactcttggtttaaagtttgacttcaagatggctcatgtaaactcttctagccaagtcttcatatgtaatttgtggataattttatctctcttactacctacctgagggcattgttttaatgctcagaaacatacagaagggattgacaaagtataaattgctattcaaaaacaggggggcctagtgacaggtgagaaaacagtgctcctcagaaaagatcacccccatcctgctgaagtctttgaataggcaacccagacaatttaggcctgacattgtagctctttggtgaagaccaaataaaatgggattggaggagaagataacatattttcaattcattttagatcatttgcatcatctgcattaggtgtggcctaatttgtttggggcttcaggtgtatgaaccagtgctcattttcatattggacatagagctggggagatagaatggccagtagtttgcaggtgttatatcattttcctgtgatgataaggacattgcctttcttatggccattcaattacattttttgttctcatttaaagtaatcagagtttcatcgtgacgacttctatgtaaatttgaatgttacatgaggtgtgtaatggaataaaaatggagttacaaggactcctgttcaattgccaacatgcttcttttctattactagagatcgtagagtggctttggggactaagaagcttagacattattttgtaccttatcattggccatttttgtgattcccaaggtgatagattggtggccattcttctgaatagcccttccaaaagtcttggtatttttggctcagagtctttgcagaattgcatcatcatgaatttttacttttaagatagcacctgttttgtcaatcctgtgagaatatgtatttcataacatgtagccacctatgggattaagtaagtactgaggtccttgagccatttccaaatgaaaagagggtatgatttatcagggcagatccagtagttcaggggcagagctaagttctgaggtacaataaagagaaacgtaaaagtaggaacccacatttcaaccatttcttcttgtttttgaggatttaataggaaagatttttagactttagttgaacaaaacagtaagataacataaaatcagactccacttaaatgcttagtttggttttgtggaactggagcagctcatggggaaatgctaattggtcaaaatagataaataggaattccacagagtctgtgagaatgattagattttaatataaggcattactcaatagtagagtaaggattagtggagtggtacaagaattatagccattgtctaaatgcaaagatttttcttcatttttacaagaagaaacttgtgagctgactaaagttcaagtttagtatttcaaaccagtgagaggaccatgtttcattccacatgaagcttggttggccatgcaggtggaattttatcaaacaacacatttaaaattttactttcttatcatatttgactattgaaaacatgacccctccctgcaactctgtttgtgttaaagcatctgcggttaatggctttctgcttcttgtattgcaaagaactttaaaaagagatcattctctgaaaataagtaccttgctggtaaaatgagtttaacttggcaagctctgtcattttttgttgttattgccatcttatgttctggaagtaattcacattagtcatcttttagaaactctaagtcatgtcttccctgtcagatatcatgctctggtagcaatttattaaatatttcctgctaaaaatgaccccaggagatagtagttaacctactcttgagtgtaataatagaatcagagattgatgaacaattttcgccaaatattttaagtaatggcataaaactaaaaggccatgcattgcttgtcttagaaaaacagtacggaacatgttagaatattacgaataaatgaacactttcatttatgagctgtatatagaaatcattgagtttctctgccagagttgcagcctgtatggtagttaatcttctcgtggcacttactgtataatgcaatgcctctttgggcaatcttttgtgttaaaatacagcatttaagctccttctctccacaaagcattgcaagaatgaattgttcaatctctcttttttttgacatcatcctagaaattatttcagaaataaccaagatggtaattcccatttaatatctttctttattgctcattggaaaatagaaaatactttcaaagcatataaaattattggaaaattaacataaccctgtattgggagcaaaattattcctatctcagcattgccacccatctgagggacccagagcaagtcatttaccatccctcaggttgtttttttgtttgtttgttttttgagacaaagtctcactctgtcgctgaggctggagtgtagtggcacaatctctgctcactgcaacctccacctcctgggttcaaatgattctcctgccttagcctcctgagtagctgggactacaggcatgtaccaccacgcccagctaatttttgtatttttagtagaaatgggggtttcaccatgtcggccatgctggtctcgaactcctgacctcaagtgatccacccgcctcggcctcccaaggtgctgagattataggtgtgagccatcgcgcctggctgcttagcttgctgttatcattattattttaatcattaaaatgaaaatattaattttgtttcaaaatgaatggtgcatgaatgaaggaggtagtccatcttcttcctaccacccaaatgacagatgatttcttttcaaaatgaaggaaatattaatttgatgacctcaggattacttccattttaaactatccttctgtgtgtttaaatcgctttcctcatttttattttcttctatcccattccttcctattatattctaatgacctcttattttaaactccaaggaatgatggtccaccccagattggcttgtgatttcttcctatacagaggctttgtcatcctcattgtggccatatgccattcctcagtatgtaaagaaggttgaatggcagggatcagccgggtctagagaaaatctcagaccccatgacagtcaatagataggaaagacataggttgaatcagatagtgcaaaatgccatacctaaaagaaaatccccagaggctctttcaaattgtgagggagatatcttttgattagaggcaaatagcactgtcagcttgaagtgagcagactaggacggctaccacaatcatctgtgaaaattgtttaatacaagtgctaccttctcataaatcacaagggtaagctcatttaaaatggacatttattctgatttttgatccatattggcttaataaaagaccaactcataaggtttaacagttcaattaaggatttttcaagataaaggattatagataggaaatttccttgtgagctgggttagaatccatgggttgttaagtttcttttccgtgtggtaagtgggaaaacatatgctgtaggaggagatatagtatgcacttgaaagtaaagtgtaactattttttaaattaagatatgaccatttttaaaatttcttggcttaggaaaaaaattgaacatgcatgtttatatagaaatgttagaccatacatagcgttattattttgatgcgaaaggatgaaaattatctgcttttggtcaaaagagaggaaatcactcaaatcctttgggacactcatttataagctctatgaaatctttggtaaaatgaactccagaatttatgcgacttcctcaagaaaaagtagcttatttttaaaataaatcataataagtaacattattattattctcactggtggtataaggatcattaataaaatagagtctctgtgatatgtgcattctaatataaaatatacatatattataaatgttctgcatcgagtgaaatacccatatttatgaaaggggttgcatgggatccatcagcaccttgtaccatgaaagttaagaaactctaaatctataccacgagcatttgaattttctggcatttaagggagaagggaaggaaggtatcgtgatggagatggggtgggaaggaattgtaatgatctgctttttatttcttttatttgtgtgcaactagcacttcgaaagaacataagatagctgtaaccttctctgctaaaccaggaggtgaacacagatgtctgaaggaggctttataaggaagtgcataaagctttagaaggttcagaggagaattgagaggtcattgagagctgagatggagagggcttcatggagaagtctttacttgaatgattcccaagaacctagattgaatctagacaagggggaagactcatctctcatcacaccatactgacccactcctgcagctgtactgaatcttgtttcttctagtaaaccatgaccttctaacctccaggctttcacctggaactctttcccttccactactgcctgggtaatgactttgccatcacagttctgtcaagttaggactttcttcagaaagtttcctgtgaccttttccagccctctgacaatttcagtttgttgctcttttttgaggggctgagaaatctgcatgcaccgacctcatcactttgatggggtcagtttgctactcgatattgaaatggactgtttaggccttgatttcctcctatagactgttggctcttccatggcagagtatgtgtgttatttaccactttatccattgcacagtgcctggcacttattagttatcaataaatgtctgtatatttatgaaggaaggaagtaatgaaggatgaaatgaatagggcatgacctacaagggaaaagtcacacaggtggaaatgatgagttggcccaaagacaatgagatgattgatggacttaaactttaactctgatgtcattttctcctaaatgtgcaatatgccataatttttttcagtaaactaggggttgagacatttttgctacttaaatagagacagaaaaataggataaattgaaaatattttccagtggtaatttattagatgcctgtaaaagaaggaacatgaggttttcagggttcaagtggatgtctcattcttcaacacaaaaacacttggagagttgtataaaagatttgaaaatcactttagaaaacaggggctacttggggaagggagttgccaggaaaatgccattattgcaaaaagttcatttaaataggcttaatatatctacctatctagtgcccactatatatataaagcagtagaagggccagctgaaactagaataggtagtagaaaggggctttcaaccaaaagccacaattattagtcaaataaaatacaatttgttggccgggcatggtggctcatgcctgtaatcccagcactttgggaggccaaggtgggcagatcacatgagaccaggagttcgagaccagcctggccaacatggtaaaaccccgtctctactaaaaatacaaaaattagccaggcgtggtggcgcacgcctatagtcccagctacttgggagactgaagcaggagaaccacttgagcccaggaggcagagattgcagtgagccaagatcacgccactgcgctccagcctgtgtgacagagtgagactccatctcaaaaaaaaaaaaaaaaaaaaatacagtttgttgtatatatcataattgacaggacaagaccctgtctcaaaaaaaaaaaatcaccaaggaactttctttcttttatatttctaaagctagtttcttttttttttcttttttttttgcatttttttccattctgtgatggcaaaagaaaatctaaccaaccccaggattttcttagtcacttcaagtttgaatgcagccccttcagaattgctcctcttagtcttctctctgggactccagcccagggagcagctctatcacttaataatagtgtgtcttgagcaacttgttttatatatttgtgcctccatatctcattgatgaaatagatttaataatacctttctcaaaagatcactgtgagtattgaattacatgaaattgtatatatatatattttatatatatatatatcgcatagtgctgacaacataataagcacgtgataaatgatagcagctgctgctgcttctcttcctcttcctgttactatcacggtgatcaacaacatcatcatcataagttccaaaatggaagggcacagtgccttggagcatctggacaccggtcattgactttctattctgacattggttgtcctttggtcattgtcctacattcccatttgcatctgctgaggtttctgtcatgccatactctgaatcttcctcaaacagaacagatgaagcctcctcaggttggccagtgctccctgggaccacaggaagcttggggtgcaggaaggctgacttagactttgtattcttgacatactctggttttcaagtttcaggctacaaatttctgttcctctgcaattgccctggactcactgggaatttctaatgctcccgccacatgcaacatttgctaggtggtggcagcaggaggtgcaagtgtggggagcagggtggaaaaggactatactaaactcctgagctctcttcttcagctttcctctttttttggttaagtttaggaaagctggttgctcatctgttggttatacactcaggtttttgaaactcaaatgtcctttctctcaacttactgtctctctgtggaatttcaaaagtgaatgtagaaatttcagcaagaatttcccatcatttgctttctgtcctgctataattgtcatgcccattgcctgaggccatggtctctgccatgagtttagttttaacaagcaaaaagtaatgaattatcaggcaggaaaataatttaggttaatagtaaaatatttccttgctacatgacaaggtgaacagctgattgccataagagatctaagaaacactaaaaagtacaaaaaaataggacattagttgtcctttggacattgtcatatattcccatttgcattttctgaggtttctgtcgtaccatactctgaatcttcctcaaacagaacagatgaagtctcctcaggtcagccagttctccctgggatagaggaaccagggaagaatcaatgcatagaagcgtcagtattggaaatgggtcttgaaggagcaatctgatattgacagcagatgtatcagggagggaacacataagcaaactcatagataagtgaacatgctttgagatgtttaggaaaaagtgaagaatgtggtgtgttcagaatgtagattcccagggctgcttgattggcttcaatatgtgaagaatattgaatgccatagatttgtgattccatattcttctaaatataagttttaaaaataccttgatatacggaagaaaatgaaaatggcctctacacttattttgatgcatacaatgtgcgtgaactttctgaaagtgaatttgacatatatattctcaaataaattgccttttctttttcagtgggtcctatgccatatgaatgtgaagaggcaagggcaaggaattcacacaaaaaagatagagggggtgtttatggtcattaaaatatgaaaaacgtaaggtgaaatcttaacaacggttagtaatgctttttaataagcagctaatgccaatcactgacatttatcatatgatgtgttgtcgtggataacaagtatttattgctcacttaacatgtgccagtcatttcgctggatactaggaggacattgttcaaaaaggtagattgggccgggcgtgatggctcacgcctgtaatcccagcactttcggaggccaaggcaggcagatcaccggaggtcaggagttcgagaccagcctggccaacatggcgaaaacttgtctctactaaaaatacaaaaattagctgggcatggtggtgggcacctgtagtcccagctactcaggaggctgaggcaagagaattgcttgaacctggggggtggaggttgcagtgagccgagatattgccactacagtctagcctgggtgacaagattgagattccgtctcaaaaaaaaaaaaagatagattgggccctgctccttggaccttagcttttagagtgtggagtcacacaataaatctggacaaacataaattaaaaagataacagattttcataagatctgtggggggaaaaacagcattgtgattgtaatagagaacaactggggagcttcatgtagacaaggtgatcagcaaagatctgaaggagaaggttatatttgaattacaatctaaagaagaaggatttagccctatgaaaaatcagagggaagcattcaggcaaagaaaacatctagtaaaatttctaagattggaataagcttatacattcaaagactacatgggaggcagcaggcgagtgagccctgggggaggagtggtctggaaggacattggagaggcaggcagggtacagaccccaagggtctcaggtggaagtatatctgggagcaggggacaccttgcctcctctaaacactttctccaaaaggagaactctctaatggttggtgacgattatgaaaagatatggtggagaaagccctgtgagattcacagtgttgacatcagaagtcagtccatggggccagcaaaaggtgttgtcctctgtgataatcagttctatcccaaccaaaggcacagcccctccattcaccattgctgatcacaatcaggctgtgagaatcagctcgagcttagcctgcaagtcatggtcaggaactctagttgtgagtgcaatgaaaaaccatctaatggttttaggtagaggagcgcatgaccagacttacatttatgaaacatctgtgtctgctgtgcgcagaatgcttttggagacagggagaatggatataatcagggcagccaggaaggagacaattgcagcaacaccacaggtgaaggcagatgaatggtgctctaggatattgacaattagtatgacatgtggcagatagttttgtaggtagcatagacagtttttgcaggataatctgggatggcaagggacaaaaggaagggaaaaatcaaggatgattcttaggaatttgatttaggaaaatgatgcactgtggtggtgtgatttactgagatagagataagaaacaagttaaagttccattttagtcatgccaagtatgggatatctctaatctgactagagtagagaccaagttggcatttggatatagggtgagggcagcaccataaggatctgaatgtcgagggaccagactgggctggaaaaatacatttggaagacataggcacatggatgatatttaaagccatgggctgaataaaagcacatagagaatcctttctttttaataataactgtgagtatgaatttttgaacaccatgaacccacccctttccctagtataatgtctccctgaataagtggaatgttctgtatacactaaattaaacaactgtggtcttgcctctaaaaactcaaaatctaaaatagaccatgatgacatgaccaaccaagactccatctctcctcttttccctgagcctttgtagtaataactcatcctagtattacagtctgcagggacctttatatttattatgtcatttttcttttttgtccttgcagccatccttgaagtgggaaggttgtgtataatctcttatttgatggactgagcaagtctctaagcaggtatttttattcctactttaggtatatgagaatgcaggccccaaaagattaagcaacttctctggtcaaggttacaaaagtagtgagtgggattgacagagggaaagttgctctgacttcagagttctaaggggtctagttttagatgaaaacctcctggatatgtcaatcttcccaaagaaatagagcagcaattaagagcaactagactcaataagaattgagtcatttccctgctcttcatttgttagttggctgaccttggatgtaacacaagcatcatagccttgatttttcaatctgctgaacaggatgctattatctacctctcaggttatttgtaaattaatacatccatctatttactcaactatccacccactaatttattttttcatgtatcaaacgtattatatactaaactcctactatgtgccaggtaccattttaggcattgggctacatctatgtagaaaataaagcgctgcccttctgggacctgtatcctttggaggaagccatcaatgactagtcaacaaattaatacaaactagaacattagatggtgacaagagaaaatatagcagtcctgtggctcatgagaaattggggaaagcttctctaagtagggacatagacaaggattaaatgagataatgcatggaatgtgcttagcatggtgcctggcgctcactagggagccacacagtcctggaaagagaagagttgaaaagcaaacatggatgttgcccagtacttcttgcttgctgcccagcctagagagagcctctgcttttggggttctttcctcccactggctaagttatgagataatttctgaccgctttatcctatgtcattgagcatgtaatgactccaactgctgtttttctgaatctgttctcaccaaacaccttctaatcatgatttaatttctcatgtcaacctgctcacctgcagagaatattctgatcatatagttttcaagtaccggacctcggttcttagatacttttcattatatgatcatatagagacactctaattataattgggtttcctgtgtagtttggccacatggagagaatatgctgatcggatggactttgattattctagttcctgtgacagcttttgctcattgtacgttaagcagctgccatcctgattgaacacactcacctcctgaacttaggtaatgtcagggcctgccatgcggtaggcactcagtgaatgtctactgattgatggattgagacttctctcaggcccatggcaaaatcaaacttccaagggtaaattcaccagggggatgatgaacataaccctcctaggcctcccaagagccagcatgcctgtctttcccaggcatccacccactgtcacttcatagactgagcacaggggccattttttctatatcagcaatagctttgaactcttgcttcaacctattccagggttgagggggaaaattagaaagtcaagcagggtgacagcagaactgtgaagaactgtgcttctcactccaagtaagcccagctgccaggcaaattcaagagcagaggtcccaaatgcagttatatttctgggagcaatgcttccctttatcttcagagccctggaagcgcagagaaaagaaggtgagggcaggggtagggtggtgggacccacttggctcctgttgatggtaaagaagtacaggacctcaagtcctaatgacaaaagtaatagtaatatgattcacttatgactcagcagacattacacttcatacttgatcctatcatttcccttaattttacccacccaaaggccattgcatatattagctggtgatagggtttggctttgtgtctccactcaaatctcattttgaattgcaaccacatgggtagggaggagcctggtgggaggtcattggattatgagagcagtttcccccatgctgttctcatgatggtgaatgagttctcatgagatttgatggtttaaaagtgtggcacttcccactcttctctctctctcctgctccaccatgctaaagacgtgtttgcttcccctttgccctccgccatgattgtaagtttcctgaggccttccaatcatgcttcctgttaagcctgcagaaatgtgagtccattaaaactcttttcttcatagattacccagtctgaggtagttctttatagcagtgtgaaaatggactaatagagcttgaaaccctcttctctttgattcaaactgacaattttcagaaatacataatgacaatttctggctttggggctaaacaaacactacgcatgaactcattggtttctctgtgaaacagagcccagtcactttatctctctgcgcttcacaccaagagatagtgtcttgtatcctattaggtatgtagtagtattttgctgtttgctacctgtggattcattcctcctgtggttcactttctataactattcttgagggcaggacttgatgattggcaactgatagagatttccattcctctactttcccagctcactctcttctcacatttactgctggctacttgccctgtgaagccgagcagaatctggaaacttcatcttcactaagccatcaataaatggagaaaactgagtaaatataactgagacccagttgttaaaaacaagagaccatcactgatcatcactgatttctttcctacaggtcatgttgtcactcgtttcttttatttcttttttaaaaattattattattattttcataagttattggggtacagtggtatttggttacatgaataacttctgtagtggtgatttttgagattttggtgcacatatcgcctgagcagtacacactctaccatatttgtagtcttttaatcccttgcccccctctctctcttccccccgagtccccaaagtccactgcatcattcttatgcctttgcatccttgtaacttagctcccacctatcagtgagaacatacaatgtttggttttccattgctgagttacttcacttagaataatagtctccaatctcatctaagtcactgcaaatgctgttaattcattcctttttatggctgcatagtattccatcatatatatatctcacagtttctttagccacttgttgattgatgggcattttggttggttgcacggttttgctgttgtgaattgtgctgctataaacatgcatgtgcaagtatctttttcaaataatgacttattttcctctgggtagatacccagcagtggaatttctggatcaaatggtagttctacttttagttctttaaggaatctccacactgttttccatagtggctgtgctagtttacattctcaccagcaatgtagaagtgttccctgttcaccgcatctacaccaacatctactggtttttgatttttttattatggccattcttgcaggagtaaggtggtatcacattgtggttttgatttgcatttctctgatcattagtgatgttgagcattttttcatatatttgttggccatttgtatatcttcttttgagaattgtctattcatattcttagcccacttttggatgtgatgtttgtttttttttcttattgatctgtttgagttcattgtagattctggatattagtcctttgccagatgtatagactgtgaagtttttctcccactctgtggattgtctgtttactctgctgactgttccttttgccatgcaaaagctctttagtataattaggtcccagctatttatctttgtttttattgcatttgcttttgggttcttggtcatgaaatccttgcctaagctaatgtctagaagagtttttccaatgttaccttctagaatttttatagtttcaggtcttaggtttaagttcttaatccatcttgagttgatttttgtataaggtgagagatgaggatccagtttcattcttttacaagtggctagccaattatcccagcacaatttgttgaaaagggtgtcctttccccactttatgtttttgtttgctttgttgaagttcagttgtctgtaactacttaggtttatttatgggttctctattccgttccattggtctatgtgcccatttttataccaataccatgctgttttggtgactatggccttatagtgtagtttgaaatcaggtagtgtgatgtctccagatttgttcttttttcttagtcttactttggctatgcaggctcatttttggttccatatgaattttagaattttttttctaattctgtgaagaataacagtggtattctgatggggattgcattgaatttgtacattgcttttggcagtatggtcatttttacaatattaattctacccatccacgagcatgggatgtttttccatttgtttgtgtagtctttgatttctttctttttttcttcttcttctttttttttttttggagacagagtcttgctctgtcacccaggctggagtgcagtggagcaatctcaggctcactgcaactcctccatctcctgggttcaagcaattctcttgcctcagcctcctgagtagctgggactacaggcatgtgctaccacactcggctaatttttgtatttttagtagagttggggtttcaccatgttggtcaggctggtcttaaactcctgacctcgtgatccacccgcctcggcctctcaaagtgctgggattacaggcatgagccaccaagcccaaaagtctttgatttctttcagcagtgttttgtagttttccttgtagaggtcttttgactcctttgttaggcatattcctgcgtatttttttttcagctattataataggggttgagttcttgatttgattctccacttgatcactgtttgtgtgtagaagagctactgatttgtgtacattaatcttgtatctggaaactttgctgaattcttttatcagttctaggagctttctggaggagtccttagggttttcaaggtaaacaatcttatcatcagcaaacagtgacagtttgacttcctctttaccgatttggatgccccttatttctttctcttgtctgattgctccctctaggacttccagtactatgttgaagagaagtggtgagagtgggcatccttgtcttgttccagttctcagagggaatgctttcaacttttccccattcagtattacattggttgtgggtttgtcatagatggcttttattacatgaaggtatgtcccttgtatgccaattttgctgagagttttaatcataaagagatgctggattttgtggaatgcttgttctgcatctattgagatgatcatgtgattttttgtttttaattctgtttatgtggtgtatctcatttattgacttgcatatcttaaaccttccctgcattcctggtatgaaacccatttgatcaaggtggattatccctttcagatgctgttggattcagttagcttgtattttgttaaggattttagcgtctatgttcatcaaggatattggtctgtagttttcttttttggttatgccctttccttgttttggtattagggtgatgctggcttcatagaatgaattagggaggattccttctttctctatcttgtggaattgtgtcaaaaggattggtaccaattcttttttgaatgtctggtagaattctgctgtgaatctgtctagtcctggagtttttttttttttttttttggtaattttttagttaccatttcaatcttgctgcttgttattggtctattcagggtatctaattcttcatgatttaagctaggagggttgtatttttccaagaatttatccatctcttctaggttttctagtttatgtgcataaaggtgtccatagtagcctcgaataatctttttttatttcagtggtgtaggttgtaatatctcttgtttcatttgttggtaaggttatttggattttctctcttcttttcttggttaatcttgctaatggtctatcaattttatttatcttctcaaagaaccagcttttgttttatttatcttttgtattgtcttttttgttccaatttcatttagttctgctctgatcttgggtatttcctttcgtctgcgggtttgggtttggtttgttctagtttctctagttccttgaggtgtgaccttagattgtctgtttgtgctctttcaaactttttgatgaaggcatttagggctatgaactttcctcttagcactccctttgctgtatcccagagattttgataggtggtgtcattattgtcattcagttcgaagaattttttaatttccatattgatttcatttttgacccaatgctcatttaggagcaggttatttaatttccatgtatttgcatggttttgaaggttccttttagagttgagttccaaatttattccactgtggtctgagagagtgcttgctataatttcaattttcttaaatttattgaggccccttttatgtcctatctaatggtctatcttggagaaagttccatgcactgttgaatacaatgtgtattctgtgcttgttggatgaaatgttctgtatatatctgctaagtccatttgttctaaggtatagtttaaatccattgcttctttgtggactttctgtcttgatgatctgtctagtgctgtcagtggagtacagaagtcccccactattattgtgttgctgtccatctcatttcttaggtctattagtaatcgttttataaatttgggagctccagtgtcaggtgcatatatgtttaggatagtgatattttcctgttagacaaggccttttgccattatataaagtccctctttgtctcttttaaccactgttgctttaaagtttcttttgtctgatataagaatagctacccctgcttgcttttggtgtccatttgcatgaaatgcctgtttccacccctttactttaagtttatgtgagtccttatgtgttaggtgagtctcctaaaggcagcagatggtttgttgatgagttcttattcattctgcagttctctgtctttcaagtggagcatttaggacatttacattcaatgttagtattgaaatgtgaggtaccattgcattcatcatgctctttgttgccagtgtactttggttttgttttttgtttttgcttgtaacttgtatttttgttttataggtcctgtgtgatttatgctttaaagagttctgttttgatatggttccaggatttgtttcaagatctagaactccttttagcagttcttgtagtggtggcttgataatggcgaattctctcagcatttgtttgtctgaaaacgactgtacctttccttcatatatgatggttagtttccctggatacaaaattcttgactgataattgttttgtttaaagaggctgaagatatggccccaatcccttctagcttgtagggtttcttctgagaaatctgctgttaatctgataggttttccttcatgggttactggtgctgctgtctcacagctcttaaaattctttccttcgtcttaactttggataacctgatgacaatgtgcctaggtgaagatctttttgtgatgaatttcccaggtgttctttgtgcttcttgtatttggctgtctaggtctctagcaaggccagagaagttttcttcaattattcccccaaatacgttttccaagctttgagaattgtcttcttcctcaggaacactgattattcttaggtttggtcatttaacataatcccagacttcttgcaggctttgtttatattttcttactccttttactttgtctttgttgtggattgggttaattcaaagaccttgtctttgagctctggatttctttcttctacttgttcaattctattgctgagactttccagagcattttgcatttctaaaagtgcatccaaagcttcctgaattttttattgctttttctttaagctatctatttcattgaatatttctccctttacttcttgtattatgttttggatttctttgcattgggctacgcctttctctggtccctccctgattagcttactaattaacctccaggattctttttcaggtaagtcaaggatttcttctcggtttggattcattgctggtgaactagtgtgatttactggggggcgttgaagagccttgttttgtcatattaccagggttggttttctggttccttctctgggtaggctctgtcagagggaaggtctagggctgaaggctgttgttcatattttttcgtcccatggggtgttcccttgatgtagtactctccctctcttcctgtggatgtggcttcctgagagctgaactgcagtaattgtctctcttctgggtctagccacccaaggagtctacctggctccgggctggtactgggtgttgtctgcacagagtcctgtgatgtgaactgtctatgggtctctcagccacggataccagcacctgttctgctggaggtggtggagggtgcaatggaatccgtgagggtccttagctttggtggtttaatgctctgtttttgtgctggttggcctcctgccaggagggggcgctttccagaaagcatcagagccgccgctgtgtcccctgccacagccccgagtttgtttccaggcggagggtgagacgggcctgaaaacttgcccaaggccatccacctcccagctgcgaaagaaagggctttagttcttccctcctccacctgtgacgtctgcactccggatttgtgccctcccctgagttcttgccaggaggcttctcagctcattcaaattgttacaaagttcgactagagaattccttctccctgtggagttttaccccctgctcctctggccatccttccaatggatccttgtggtgccaggcaggaatgggctgcttggggacctaggaagcccccagggcctttctgctgcttcttctaccctcccccacacctttactcgactcactaacttgactcagctccaggtaaagtcagaaatttctgcaaacagaccttcagcttctccagtgggggtgtgtgtttgggagaggagggtctccctttctcagttccgcagttggggcactcaatatttgggggtctctcgggtcctgcaggagcagtctgcttcctacagagggtctgtgagtcctttcgggattgctggtttgttcttgcagttctgaagctaaaattcacaatgcaagcctctgcatgctgctctgtctagagctgcaatctggtcttgcctcccgtctgacatgatcccaggagctctctgagagagcaacccaaaggagctgagagagatccggagtccccgatgtgagggagcatcaggctgcaaggacgcggcactggcgatggtttcgcaggggcatctgttcccttggggcgtggaatccctgctctgccgctgccccaactcggctccgaagtgcctttgctgcaagatttcctgagcttagcagtctgcccgtttcttttctttctttctcttatttttccccctgaatgtttggtttctctggcaagcccaaacacgtaagattatatgtgaggcatatttatttacataaagatgcgtgttttttcttaactcagcatttacatgtagcttggccaagttaattaactgtagaagacctcaattttgttgtcttttaaaacaaggcagctgtattagattagtggttttcaaagtccgttagatggtaaagtgcctgcaagccatggcctgctttgtgggataccatgaaatattaatacccagagctagacttaataagcacacgtataattttgtgatcccaaatactatcttatatatgattgtaatagagacaaaagttagcatgtatggagatataaatcattaattcattcatctatcacataagtgttattgagtgcctacacaaatgtttctcaaaccagcattcaccacctggagaacctattaaaatacagatcactgagccccattcagctgtttaaccgacgatgctcatgttggttcagctgatctgggaaccaaattttgagaactgctgacctccactagtccagcccacgaattggcaaactacagcccctgagccaaatctggccctttcttctttttgtaagtttcactggagcacctcacatttatttatgtattgtccatagcagcttttgtgccacaatggcagagtttagtagttgtgacagagactatggcctggaaacctgcaatattatccgtgattttccacacaaaaatctgcattctgggttttgtatgcaataagtcatgtacaaaagtatggagctgatgtcctgatggagcttacattctaacagggcactaaaaatttagtgagatttaaagaaaagttataagagaacatcttaattgaggtattctactttcaattattcgtaaccttattattatatatttacttcttttaaggataacatcttcattcatatttctataactctagcgcatgttccaatggcttcaagtttgcatgattaaaatatctctaaactattcttttcctctcagtactttctcctttcagtgtattctaggtaacatttccagagaaaatatccttaatatagttatgaattgatgattgcctccagaataaggttttttaaaagtaattttgactttattttagattcagggcgtacatatgcaggtttgttatgggagcatattgggtgatgctgaggtttggggtgcagatggtctcatcacccaggtagtaaatagtacccaataggtagtttgtcaggctatgcccccttctctttctccccaaccagtagtccctagtgtctattattcacatctttatatccacgagtactcactgtttagctcccacttataactgagaacatgtggtatttggtttcctgttcctacattaatttgcttatgataatggcctctagctgcatccatggtgctgcaaaagacatggttttattcttttttatggctatgtagtattccagagtgtatatgtaccacatttcctttatccagtctaccattgatgggcatctaggttgattccatgtcttcgctattgtgaacaatggtgtgatgaacatacaagtgcatgcatctttttggtagagtgatttattttcctttaggtatctaccccgtaatgggattgctgggtcaaatggtatttctattttaagttctttgagaaatctccaacttgctttccacagtggctgaactaatttacattcccacaagctgtgtataagtattcccttttctctgcaaccatgccagcacttgttatttttttaagtttttgttaatggtcattctgacttgtgtgagatgatatttcattgtggttttgatcagcatttctctgacgtttagtgatgatgagtattttttcatgtgtttcttggccacttgtatgtcttcttttgagaagagtctgttcatatcctttgcccatttttaagggatttgttgttgttgttgctgttgttgaattgtttaagttcttatagattctggatattagacctttgttgaatgcataatttgtgaatattttctcccattctgtaggttatctgtttactctgttgatagtttcttttactgtcaagaggctttttagtttaattagatcccacttgtcagtttttactgttgctatcacttttggggacttagccataaattctttgccaaggaaaatcaacgttatttttcacagaattagaaaaaactattctaaagttcatatggaactgaaaaacaaaaaaagagccaaaatagacaaagcaatcctaagccaaagaacaaagccagaggctttacgttatccaacttcgaactatactataaggccacagtaacctaaacatcatagtattggtacaaaacagacacatagactaatggaacagaatagagaacccagaaataaagccacacacctgcaattaattatctgatctttgacaaagttgacaaaaattagcaatggggaaaggacaccctattcaataaacggtgctgggatagctggctagctacatgcagagcatgaaactggacctctgcctttcaccaaatacaaaaattaatccaagattgattaaagatttaaatgtaagacctcaagctattagaattctgcaagaaaacctaggagatacccttcttgacagaataaagatctgttctaattattccacattgtgacaccaaaccatgaccactactatatcttccacctgacatttcccacagtctcagctctgcatggacctgcccagaatggagatagcaatgggcttaccatgttgacacagcctctgtcacttcctattttctctctgactcaggaaggagtcacttcactcttgtaattcttctgccagaaccctggaggtatcttaacttacaacccccagtctataaactctccactaaagccacactgattgactcaccatcttccaaataaactttattgattatttgctactaatatgagttactgatgactaataacagattatctcaaaattgtgttcttaacacaataatagattttcctttttaaatcttgtagtttccgtggggcagagtctggggagtggcttattttggtagttcttgctttagggtgtttcatgaagttgcacttacaatgctgatctggattattcatctgaaggctcagctgggtctacaggatcctcatacagtgaatgcaccgttgagctggcaaattggtgctggtattgctttggacctcacctcatgccacggaggctactcctcacagagcaagtgaggcaagaaaagaaaacataagccacgatgtcttattttgtaaatttttaaaatttactttacagtgtcttttaagatatagccccagaaatcacactctattatttcagcaatattatatttttgacacagatcagtcttaattaaagtggtaatgacacaggagcatgaataccagggggtgagaatgactgacaccatcttggagccacaccatcctaacccctcctactctagtcagggcttttgcctttgctattgttttcctatttgaaatgtttgtttgtttatttatttatttatttatttatttaatttcctaaatctaaccaccttttaatgctcatttctgttccatcttccccgtgacaccttctctgaatcctttagcctgaagaaattgcatcttccattgttctcctgtggtctcattatcaatatcacacattttagcagttactcacagataggaaataattcctgttcacaaataaaacattctgaggaactcagttcttcctattcgaggaaatcctccactactactacaaaaacctgcataaggcattgaaaaaaaaccctccgttagagattgagctgtattgtagtacataatatagtatgagtaatattaatatggtgtatttgatagatgttagagatcagtgtctaccagagcagtactactcaaacttaaatatttatatgaatcatgtagggacctagttaaatgcagattgagattctgtgggtataaggtggggttgagatgctgccattctaacaagctcccaggtgatgctgaggctcctggtccatggaacaacttttgagtagcaaggtgctagaagatggacataaaatggacataaaatagaataggagttgaaagtagatggaaaataaaagtagtgaagagaatcatggctgtgttcaatcagtagtactggcaaggcataaatatttgaagtcacgaatcactcaagtatttctttattgctctttggtactgcccattatctttatacatgcatgtatgttttacctcttccagccttgattataggcccctttaggattgaaggtgttccagtcacccatagaggtgaaatatagttccctttctggagtagttgctcaataaatgtgtactgcttgattactctgctgctaattctcacggtcatttattaatttctattattacttccccaagttttctcctttcaaaatattataggaaattcaaaatacctttctattataaattgatgtgttttatttacagttccttatgatatataatacaattcctcataaaaaaataaaattttagttggtctaaataccaggtaaattaacatgatcaaattaatagaaaaagtatcatgcccaggtaacatgtcagaccaattaaatcagtctttgagagaggattcaggtattggtattttttaaagccccatgggtgattccagagtgaagcaaaagttgaggatcaccagtttaattatcatcctactatattttaagatagaataattatactttattttttattgtgccccaaagcattttttttttaaatggagtctcactctgtcgcccaggctggagggcaatggtgcgatctcagctcactggaacctcggcctcctgggttcaagcagttctcctgcctcggcctccccagtagctgggattatagtcaccctccaccacgtctggttaatttttgtatttttagtagagatgggtttcaccatgttggccaggctggtcttgaactcctagcctcaaatctcagcctcccaaagtgctgagattacaggcacgagccatggcacccagatccaaagcatcttttacaacatgtaatttggaaatatcaatgaagaccaattcagagaaaaatgtttaccttcctttttttttcttacaggatgtagctgcttcaatttataaataagtatagatatgctatagtaatttttgaaattctatagcaaactaacttttccataaatgaatatggtttcttaattatcccaagcttgttaatgtaggttgtactttttttcttttagcaaacacatcagatcattttgccaaattatccaagtcattttaaaaacataaagatattttgcaaatattttatatctgccagtcaaagtcagtcttggtcctaaataggatgttgttacatgcctgccttataaatgttagcatcacggaaagcatttttgtttaatttagaaatgtttgagctcagaggaaataaggatacttatctcgtttactcagctttagtaactgcaaaaggcagaataaaggtagcttgctggagttgctagaacccacatacagtcagaatatatgacctctcctttaagctctgcctcttactagctgggtgacctttggcaagtctcttaacttctgttagtctccattgcttcatttgtaaagtgaaagggttgaagtagacggcacataagattcttatacctggaaagtgatggggtgagggactactaaggtcctttgagtgcttcttggttacgcactgtgagaagtgatggaaaataattcacactctcaaaaattccatgactctataggagaattttcaagtgaacaggcacaaagtctctagattgttaaattaagcctatgaaaaatgaaggaacataaaataaaaagagagtaattgcattggttctgattctctcatagaaaaggaattttacacgtcgttaattccaatgctttgtattacagatgaggaaaccgaatcccaaaaagttcaaataactttctattactaacacataaaatagcacactaataggggatgaaaatttatccagtttaacaatccagtccttcatgtcaatcaaaagcttctttatcaccatcataattcaacatttcattctgtattgagaaggaggtggatctaagatttatatttatgatattcatgataattcagagtttctgaaactgacatcacaggaagattttcacaagtgggccaggatgtgattcatgggccctgatgttacaagtccagattggcaaaccaagggctgctatcaaagggactaagttggatggctttctggataaatatttctttgtagctggatttacaaaggttatcaaccctccagataaaaagtcatggttcttctattgccctaagagtcatagatagtaagttacacagtaacatattcattttatgtatatacatacatacatatagtcatgtatagtaaattacatgaaaacatcagtggtgccatacactcacctgatcctgggtgacggaaacgagtatgaggaatttaagtagtccttctcaaagtcttccccagagatcaattagctcatcaccattttaccatgagggtatgctcaggggagatatgtaactaaagtcctgataacttgtaccaggtgactgtaaatcattcagtattcagttagtcaacaaaatcaacaaataattatcatgcctctatagtataccaggcacttgctgggcactgggaatatggtgattaataaataagactgtccatgcccccagcttcatattctagtggaaagggaaagatatcaaaacatgtttgcaaggctgggcaaggtggctcaggcctgtaattctaccactttgggaggccaagtcgggcggattacttgagttcaggaatttgagaccagcctggccaacatggggaaaccccgtctctacaaaaatacaaaaattagctgagcgtggtggcgggtgcctgtagtccgagctgtttgggaggctgaggcaggagaatcacttgaacctgggaggcacagagtttgcagtgaccagagattacgccactgcactccagcctgggcaacagagtgagactctgtctcaacaataacaaaaacaacaaatacttacaaaacgtaaaaaaaaaaatccctttagatatttattagtgtgataagaaagatgagaaagcaaatgccatagagaatagagggtgaagagcaaaggctgcatggtgtgagtggtcaccgagttcttctcttaaaggcagtgatgcttaaactcagttgtggagagggacgcagtgtcaccaagttctgagggaaaagtgtttcaagcagaagaagcagaaaatgcagtggtcctgagatgagaatgaggagctctgcacttctgccagaagaggcattgtaatagtattggagatttgaaatcgttattttactcaggcatttattaattaatatattatttattcatcaaaatacatgttgagactactgtatatcatggcctattcaagacccagttcccctgcccttgtgcagcttagttcctggtgggagacacagacaataaataatacccatagtaaaaagcaaattatataatttgtaggaaaataaggactatggaaggaagaaaaatttgggtaaggaggaccaggagcctggggatagggaggtcagggagggcttggctgagaaggtgacatgtgatgcaactgagggatgtgagggaattagccatgcaggtaggggaaagagcatcctgggaagtggggacagagcacagacatgctggagaaacagcaaggaagtcagggaggcggaaacagagcaagtgaggagaagatagtgggaggtctcaccagagagggagccagaccctgttcaataatgcctcgacttgagcccagcatgctggctcacacctgtgatttcagcactttgggagcgaggcagtaggattgcttaaggccaggagttcaagaccagtctgggcacaatatcaaaaccccatctctacaaataaaaaataaataaattagctgggcatggtagactggacttggtggctcacacctgtgatcccagcactttgggagctgaggcaggaggattgtttaaggccaggagttcaagaccagcctgggcaaaatagcaagacctcatctctacaaataaataaataaattagctgggcatggtagcacatacttgtagtctaagcaactcaggaggctaagatgggaggatcttttgagcctgggagtttgaagctgcagtgagctatgactgcactccaacccgggcaacagagtgacaccctatctctaaaaataataataataataaattcattgaataatgccaggagtttttctctgagaggagtggataggtattacagggttctttgatggcaaagaaccgaggaatcttattatccccacctataggaaaagcacctagggaggctggctttccatgcagaggaggaaccaccagggggcggtgcaccgcaaagtcgggctgtggtggccctgcagatggcggtgaacgggaggagcaggctggcttttccaggctcccgctatctaataagtgaatagcattgcttttctgggaaaatctttttaaatgttttttaatatagaagacttttaaaaacattgaaataataactgtacctataggccaggtgtggtggctcatgtctgtaatcccagcactttgggaggctgaggtaggaggattgcttgagactaggagtttgagaccagcctgggcaacatactgagaccctgcctctacaaaaaataaaaataaataaattagctgggcatgatggcacaagcctgtagttccagctactcgggaagctgaggtgggaagattgcttgagcccagaagttggaggctgcagtgagctataattgcaccactgcactcccgcctaggtgacagagggagacctcatttccaaaagaaaaaacaaaatatattataatatttatgaggtatgtacagagttttaatacatacaatgtattaaagatcaaatgtggataattagcatatttatcacctcaaatatttgtttgtgtagagaacataaatcctctcttctagctatttgaaaatatataattgtttactgtagccaccctataatactatagaacactagaacttatttgtcctatcaggctctaattttgtattctttagcaagtctctcactaaccctccaaccctactacctaattctcagcctctagtaaccactgttctactctctacttctataaggtcaacttttttagcttctacagactctgatttaaaaacgggctaatgatccgtacgacacttctcaaaagaagacatacagaaatggtcaagaaatatattaaaaatgttcaacattgttaatcaccaaggaaatgcaactcaaaaccacaatgaggtatcatttcaccacagttagaatggctattatcaaaaagacaaaaaaaaaaaaaaaaaaacaattgcgggtaaggatgcaaaaaaagtgaacccttatacactgttgggattgtgaactagtacagccattataaagaataatattgaggttcctcaaaaaactacaagtctagatggctctttgacttcctaaaatgacaacagcaagctatacacagaattaaaatataaacatactcccaaagccatatataaagtacctgaggcagtccataaaattttaaatttcaatagagtactaatttaatcagggaaactttatctacggcattttttgctgtctccattaagcatgttatatgggctctcagaaccctgaagatcttcatccaaaagggaagttatactctcattttatctctaacagatgtgggcatcaagtgtttatgggcgtgaaaaaggctttccattaaaggaaaccctgtcaagtagcaggattttcttttattatgttgttttacacacaaaacattttttttgaaatcaccaagtctgcataaacctgaaaaaagcaaagtagtattttcataacacatatttgtctgtcactgctgtttttggcggaaattgtcccaacgagatctttgagttaccggtttctaagtagcctccagtcttgaccttccagaggcctcaaggacaatgatgtattggcccccagagactacttttggggctccagcattttgcaaacacatgagcaaagttttcttttcctgaagtcattttatttatcttcgctgtttccttccgcagccctttatagaaacagaattaaattgtattgggaataacaaggaggaaaaataattcacttatattttattgctttaatattttgtattagcattaccagtgatttatgtttcctgctccggtgtccccgttttgaattctccaagtctgtgaagggtgttgaagacaggtaatcggtaaataggctttcaagggagaatgtgtataggtgtgggtgaggtgaattaaggcttattttctcattgatctttcgctttgctttccaaagcagcggacactgggttgcacatctctgttcagttacagggaggggagggaatgcccagtaatttcttatctcgtggtatgttaattgctaaaatataaacaaaggtaagaaaggtgctttgtgcaggtgtaagtctctgggcatttgtccgtgactcacttctcagtatatcaagaatgatttctttcctccacagactaaccaagccttaactgtcaggttagccattctcatttctccctgcttggcctcgatcagctgctggccttccccgggagaaagagcctccatttgctatgagctccttgccggatggagtgattgccagcacatcccagtaagactgcagcaggtgctgcagcttggggaaatggcgtgtgttttccttaccagtacatgtggcttttgagctttgatttcacagaaatgtaaaaaacaggtcgatgctagtatgtactacattcctaccagcatacactttcaatccactttctgacaactggcttgtatcactccctgctttagagtaatagcacctttgcttgaagtttcttaggtgaaaatcatgaaggttcccattttgctgaatctctgtgttactgattaagagagagtaactgcgacaggggtgggcacctgacaacattttctaaataacattagcatgttttttcctcttcagccccctgggtttcaagcatttgatttgaatttttttccctactccctttcttaaaatgcatgactaagaaactgtttctttcttcactgatccttggttattcgctttgaaaaaagacgacagaacaagagtatttccaagaatacaccagtcctattctttggtgatgccactttctaatttaatgtgatccagcagccaaaatgttgttctaactaacatatctccttgctaaaaggtataaaacaggcatcttcaaactatttcttaagaaggctagagtcaatattttaagctttgtgggttgtactgcgtctttctcaactgctcaactctgtgttgtgcataaaaaagcagagctgtgttccaataaaactttattcacaaaaacagatggtgaactggagttggcccacaggccgaatgaccctgggtttggaagatgcttcttggaacttctggcccagctggtttccatctgcctttagctgattaagaagatgtggccaagggttccactgccacctcccccaccactactaatttttactgatcagattacacatcttatttttcactctatttgttctagacctatcactaacagggcaggcaagagccagggaagttgctcttaaaaaaaaataaaagacctggaaacccaaactctctatactgtggctttattttgtcatccaagcttggaagggcagctctcattttggcttccagtgcctgtctccattgccatttctccctctttcagtcctggcaggctgagagctttatggtctcctaaccttgcctttgcagcatcactagccctggtaataagaacaccatccatatactagccctttgacaatgaagaaagctgtccacatgtcttacctgatgtggtcctggtccaatcatttaagtaatttttaaaaattattttctgttttgacaataagaaaacagccctggagaggctgaatgacttgcttaagattctgcatctcatatgcagtgcaactaggcttcacctccactattctcactctaaatcctggtatctggcctctacctggtactgtttctcagtcctgagtcattaagggtctggcttcaggcactcctctgtcacattttttcttggatagattattaataccctgagatgccagataccattctgcagagagaagaagaaagccacagaaagccgttcaggctgagaatgtttaaaaatatatggtgctgaccaccaataccaatggcagcagaggaggatctttagtaaaggattttcaaagatatagagtctgtatctcagagtttaaaaaagaccattgctatacaagatgctccgatcagctctggttctcagtacttataaagcagcggaatctcctgctttatgaactttagttctgggcttcagctctgtattagtctgttctcacactgatgtaaagaagtagctgagactgggtaatttataagaaaaagaagtttaatttgctcatggttctgaaggctatacaggcttctgcttctgagaaagcctcaggaaacttacaatcatggcagaatgcaaaagggaagcaggcatgtcttcacctcgatggcaggagagagagagagagagagaaagaggaggtgctacacactttcaaacaaccagatctcgtgagaactctatcatgagatggcacaaggaggatagtgctaaaccactagaaaccacctccttgatccaatcacctcccaccaggctccacttccaacattgggaattaaaattcagcatgagatttgggtggggacacagagccacaacatatcagggtctggtctggtcaggggtaggttgcaggagactagggaccaaaatgatcttaccaaagggtgaaaaggtaaacacagaagttaaacagcaacactgaaaactcatagtccatgaaatccaaggggccaggagggaaggctgaaggttattaagattaagaagatcaaagcggaagacaaagttgggatatggagccagcagtagatgtgttctagtaaacacacacacatatgcacacacacacacacacacacacacacacacacacacacacacacggtataaatgatggaaaaagaggcagtggtttataaccatgccccaccagaaattctacctggccctaaattagtgtgtttaactatgcacattaaaaataaccaaccaaacaagcaaacaaaaaccagtcaacccaggcctgctgatatatctgcttatctccttggcaagggccaaccacagaactaagatgatttaagtagatctgtaaggtttctcttcccctgttttctgagtagagaaattcactggaaatgggattctttgctccactaagaagtccctggctcctgccactatccctttcctgcataattgtcttaaatcctctggtaaaggacattttagccaccttcttccagaagctacttttaaaaatatttgaagtagagatttgaagaaaagtggaataagtagccagaagccaaagatacttaagaaaccaagcagaggctctttcctgctaagaagaaaagttgggggatggtaagacaaacagagaagctgggtagttgcttaacgagatatagagcttttaggcttgattagggtcttaacaccttcctcatagggaagcactcactctgaatctaatgacattgtattcctatgacacatcaataaaatgcctacaggagaagcatctttgtacaaacttgtgccatatactttttaaaaatttttactaataaatatgtgtcatatattttactaatatgtgccacatactttactaatatgtgccatatacttttttattcctactaataaatatgcatatataaacatgatatagatatatgtgatctatatatgtataaatatatactgtgtgtgtacaagtatacaaattgtgtatgtgtatcttgtttaaagttccccagttttttcaattaaatactcacgaattttaaagagatcaagaagtcttctggcacttagaattgcattctactcaatgatatattgtaggtggaactacatacacattgttacattgttacaggaaaatgccagttaagatgttgtttaggaagcaataccaagggttcacaggtttatattagaaattagtgtctttagctcctttctgttgggatttaattttatgtataaaatgccattatgtccaaatattttataatgatgagaaaaccagttcactttggattatcttcattttttagtgtgattaaaaaaaaatctggctgcaattcttgtgcattagttaagaatgtgatggtgtgcagtcttttaagtcatgtcagcaaacgtgtatttccaaggtcagctctaccaaagagaatagtatttcttttgcaaccctgatcttacttggggatgaaaacaattattgcctaagttagaaatgtaaacacattaatgcaaaagaaaaatcaacaaaaacttatagtattaaaatgcacatcattttatgtgtgtatgtaaatgtatacaaattttactgatgtttttgcataaaaagataatcaaggctccatcactaccaaatttttagacatttagaaaggaactagacagtattttgtggttttcctgtctatgagataagttttgccagtaaatcaaacaatagtgcaatagacatgttgcatatattttgttagtttaatacctctttatcagcacttcatttagggacactctgctaattttacatactgtatgtcttaattaaataatgctgataattggaacgagtacaatgtattgagaacttatttgcctgccaagccctaatcgaagtgtttgatgtttttgttattggtcatttcatcttcgccatctttggaggtagatcattttatcaccctcattttacagataaaaagattcaagacttgctctgcctcctccaagcttgccatgcatatagtgataaacaatttaaggttatatcaacttctttaaaagtactaccccttcacagtaggttggcatttttactccaaattatgcaaggtgttatggcattttacattataatagcacagaaggtaaataaaactattaaattatttatcttcattcattacagatactgcaagagaaggtcaactgctaattctctttcaaccagcctgaagtagtgactaccattaaaaataaaaactatttaaaaatttgtcccaaatatccgcttaaaaaatgctttctgatcagttgatttaaataacgttatttggcaattgaaaggcttgttttgcaaactgttagaggaagaatctctcctacgaatggttttattctgtagtaaatgtctcctccagatacatggatttttaagccagtgtaaggtgtttaagacatggtcgattctagatatgtgttcgcattttgattacaagcaaatgttccagacccatttctatatttctcggacttacttggaaaggcaccaactaaagcagctgggagctgctggagaccattttaaatggttagttttcaggagattagcagggagcactgccttttgtactcaacactgagtttgaggtttttaaaagtgcacaagctttatactttacccccaattctattttacagtgttttaaaaaactttttttgttgagtcaccttattctttttctcgctcatcacaagacaaccctacttttaacaagaaacaacaaaaagaacagaaaagaataaaaactcacagtgaaagccatcaacgggttttctttttctgagcaccacttttggaggcattatcctttataacaggccctaagtgaaaaggaggaaaaagaaactttacatgattaggaaaggctgggaatgaaagatactgaaaggtgtaatgggaaatgaaaatatagtgatagaaaaggaaaagtaattctctgttggcgacaatgttatgttccatgacctgctcacactattttcttgtggacagcttcctcaaatcccattctgttgataaaagcatattaatatgatcaaccatgaaccagcaccaactgagaataccacttctctaggttggttgtaactgtttctttctgacttaaatactaaatatatcctctgaaataattacagttgtttgttacatccctttagttttagagaaaaattaaaactctcatttcttccttaaggaggctagggctaataactggagttgtatttctttttcattgtaagcccaatcaatttgatttctttttctcctaaatgaaaacataggctaaggccagcaaaaagccataattgggtgactaattaaatagtcaggcatctacagcctggtagagttcagggcttcctagttgaaggaaataaaaccataaactgctatctgtgacagtgtatatgaaagaggtgaaggatagagctgttgtgttcactggtggatggaactatgtattcatataactgcaagatttatggagataacatgattgggaaaatataaaacattaaatagattatgccagaagtcttgcctccaaatgtctaaatccttcaaatgtgtcattgccactacctgtggatcaaagaacaaaacagggatgtgagcgtgcagccctaatctagacacctgagacatgaggagtgcctgccaggaagaatttagaaggagcaggccaggagctaggaggagaaagaagaaagggtgacgtggattgtcaaatggggcctgagaattgacccttgcattgggtgaatggaggaccttgggaacagctactttggtggaattgtagggagggagcctgattcgagtgtgttcaagagtgactggaagcaacaaggacaggcaactctttcaaggagatctgctgtaaaggtagagagtgaacagaagcaatagctggcatggaaaatgggatcagcaagagtggttggacacagaaaggctgacaactagtagtggaaggtttttgatattgtggtcctgaaatgtcctcatagcatgttaatgtccatgttttttattgtgttttctctctttttttttttttttgttttgagacggagtttcactctgtcgcccaggctggagtgcagtggtacgaatttccggcccccaggttcaagtgattctcctgcctcagcctcccgagcagctgggattacaggcgctaatttttgtgtttttagtggagatggggtttcactatgttggccaggctggtcttgaactcttggactcaggtgatccaccagcctcagcctcccaaagtgctgggattacaggcatgaaccaccgtggatggccttttattgtgttttctaagcaaacaggcaagttattctttaatctcatttccttgccataaaaatatagcttaatttctaccaaaaacattggctcccaactgtatattaattatgattatgagttttaagtgacaattgcatttttacatagaggtaatgccgaggacatgaagttattttggatttcaggaataggtagtatttgttccaagccctgtggccatgaaaagccatctttgttcagtcctcaccaaggcaatgtagggtggataagcagtgtagggtggatcaccaaggctaggtgtggatcagcaagccttcctccttaaaaccgactctcagtcttgaacgcccagagggaagaggtaggaagtactgtttttcagctgtgatttcagaagtccacggatatttcaaaatcagcagtctccatcttagatccatgacttacgggggaagttataccccctaacgatattgcagaatagtagtaaatctaatgagagaatatatgagaagaactaaagtctgtccttcgattttccttgtgaccttggataagattgttggttatcatctgtcagctcagtggcccttctttggatgttaagatggtggtattaaccaccagaaatgttttcaaaaggcactctgcacattaaaggttctaattatccttcttcaagctagtgtcagtgctgattattaaacagttttctaatcctaactggcctgattttttttcaatgcagtccttcaaattatccttttgcaatgataaatctttcctaaagcatttaattctgcacacagagaaataccactgcttactcacgaatgctactgaacaaaagctatatttatttcttgttcaggttgtaaatattagaaatttatggatgatgatttcttaagaaataagcactataggctctgcaatgactggcagttctgttaaaagggattttgaacaagctttgaggcagagactcctgcagaagaatttatgcactttgccgactctaagaaggtactgcagcaaactaacagaaatttacttgttttcagcatgctgtcatagttgtgagtgaactccagagttttctttactgtctaagcagtctttgaagtcatctatttggtgattagctgtgatatgccttcctaattagggaaaagctattcaatcatctcctcacagattcctccaaaagcttgttttgaatctcagaaatgaccaattttaactaagcttcaatgaaatgacccacttaataaatttaaatacaatcaccaaaaataaatgttggtttgcttggcatcatgtctttccatctttttactttcttttatttttaaatttatttatattttttattgacacataataattgtacatatttacggggtacagtgtgatgttttgatacaggtatgcattgtgtaatgatcaaatcagggtaattagcatatccatcacctcaaacatttatcatttctttgtgataggaacattcaaaattctctcttctagctattttcacatatgcaatatctttttaattactacagtcactctactgtacaatgggacatcactacttactctttttttctaattgtaactttgtacccattgaccatcctctctttatctcccaatgtcccctaccctccccagtctttggtaatcactattctagtcactactttgataagatcagttttttagctcctacatatgaatgagaaaatgttgtatctgctttctgtgtctgcttatttcacttaatgtaatatcctcaagcctcatccacattgtcaaaaatgacagaattttattattttttatagccaaatagtattctattgcatatatttaccacattttctttattcattcatctgttgttggacacttaggttaattccatatcttgactattgtgaatagtgctgcaataaacatgagcaggcagacatcgctttgacacactgatttcattccctttgtatgtatacccagtgatgggattgctggatcttacagtagttctacttttaattttttgaggaacctccatactatttcccataatggctatatactcaaatttcatttttaaaaattttacatatcacctagttatttctctatccttctgccttctctgcactaatcacaaattgccctaacccagggtttcaattgatagaaccaaccgctgcatctttacacgcaacacattggctgattaaaaatcaatgcctcgttagagatgcaatttgtgttttgattagtgtttcggttatgggtttcctgtcctagaatgtctgccttaatcaactatttttgctttgaatcaccctggactattggcagtgagaggtacatctgcatgagtctccactgagaggcttttcttcctatttatgatacctctttgttcaccaaagggacaaaaattctggcaggtcttaattaatgcctgatgtaaagggatgattaagacatataaagccatggcttctgttttagcttttctaaaatgaaaatatagttgagagaagtgcttttttcagtagggtgtagcaatcaaaatcagcctggttcattgcatagttgtttgatttcctggacccattatgttggggttctgtgttttctttgttagtgctgtctctccactgaactttggtcagatattggggggttaattaatgcatttccaaaatccagaaaatatttttaaaacctcaaatccatcttcatgaaaacttttggctaatctatgttaagtaagtctcataacctacacatgggtgggcagattactctgtagaaagtaccttcatggcatgccatgagcatatcactatccttaaaagcacattcatggtgctggcttgtagacgtgcttccagggacattgcattgcaatggtctacatatctgaagtcttgtaacccatgagcatatgcaagaaagtttttcctcagaagcaattggcttgttactcacagacttcacagaatcgtcttgcaaatgttgtaggtttgccaaaatcttctgttaagtgatcattttgctaaaagattaacttcccaaatttctgtgcacttttaaagctatagtttcatccttgaccctttcttgatctctgttgtttttgaagaagtgtattttttagtacaaaaaatatatatcattgtagacaactcataaaatactaaaaacaataccaacgtgtccacaatataaagataactactgttaacattttgattgatttattttagaattttttcctaagttaatgtaaataatcatttttaatttatttttatcacaaatgagaatgattttataacacatattttagggaaattttcttttatctgatttataccctcacagtgtgtgtatgatttgtgtattttgggtggatcacacaaaccctatacataaaagagtgcatagaatgtatctgaatagtttacagaataattatcaaataaatattcctgataaccatcatccttgccaacaataattagcaaaacaggagcccctgattgcgtcacatttttcttctctaaaaataactactgtcctgacttttatattctactaggtgtccctaaaaatacagcatgtttttattgtttttgaatcttatataaatgaaatcatattatatgtattctttaccaaatttctcctgttgcttaaaactacatttgtgaaatgtattcaggttgttgcatgcaactttaattaatttgtctttaatactctatggtattccattgaatgaatttgccataatttatatattcaactttctcttaatagtcattaaggataatttcagtttagggctcttaactggtaatggggctatgaatggtttgggacatgtctgttagagaatatgtgcaaagttttactaatgtagatgcttatgagtagaattcccagggcatagacatcttcagttttgctagacaacgcccagctgtttcccaaggaggttgtaccaaattgacacttagaaatagcagtttcacatcctcaccgacattttgctattatcagatttttaaaaatattttgagaatctaaggtatgtataattttattagaaaatagattaacttggcattctcaaattactactgagtttgagcatatttctagatagcactatattaatcacttggatttcctttttgtgaagtatctcttcaggtctttgatccattttcccccttgttgactgtatttttcatatttatttgtagtagctatttatttattctgaatactagtactttgccaggtatatgtgttataaatatattttccatttcagtggcttatcttttttttattttactctttgcatgatatctttgataaagtgaattttataattttaataaaattgacataatccatctttctcttattctgtactcttaatattctatttcaagagaatttcataactctgaagtcatgaggctatcattttgtattatttctctaaaagctttgcagttttgcctttcacttttacatctttaatcgacctactattgtcaaggatgaactagagatatgattttatttcttttctatattaatatccagttgtcccattgatacttactaataagttcattctttcctttgttatgtgtcaaatgtctatttacctgcaaacgctctgtttcagtccttacatcaacatctcttgcccctgagttttacatgttaatacatagatgttcttttaaatgcagtttaccatcatcttaaaaaagaaaaaactttatttttagagcatttttaggctcacagcaaaggtgagaggaaggcacagagatttcttgtgtacccaccacccccacacaaacatagcctcgcccatttgcaacatctttcgtaacactgatacatttgttacaatccatgaacctacatttacacatcattattacccaaaatacatagcttacattagggatttctcttggtgctgtacagtctatgggtttggacaaatgtctaatgatatgtaccaccactatagtatcttacagagtattttcaccgtggtaacaattctctgtgctctgcctattcacctctcccgctcccaacccactgacgatcgctgatctttatactgtccccatagttttgcctttctaagaatgtcatatagttggaatcatacagtaagtagcctttttcagattgacttctttcacttagtaatatgcatttaaggttcctctgtgtcttctcgtggcttggtagctcatttccttttatagctggataatatttctttgtttgcatgtaccacagtttatttatctattcccctactaaaggacatcttggttgcttccaagttttggcagttatgaataaaactgctataaacctctttgtggtggtttttggaggacataggttttcagccctttgggataaatactagggagagtaactgctggattacacagtaagagtatatttagttttgtaagaaactgcccaactgtctttcaaggtactgtaccagtttgcattctcaccagcaatgaatgagactttctgttgctccacatccttaccagcatttggcagttgttttggattttggccttcctaataggtgtgtaatggtatttcaggattttatttcatatttacctgatgccacatgatgtagtacatttttctcatatgtctatttgccattctttgttggtgaggtatcaagatttttggtccattttttaattgaatggctaattttattattattgagtttcaagagttctgtgtatattttggatgatagtcctttatcagatgtgtcttttgcaaatatattctcccagtctgcatcttatcttttcattttcttgacattatcttttcaaagcagaagttttgagttttatgaagtttagcttatcaattacttatttcatggattatgcctttggtgttgtatctgatgagtcattgtcatacccaaggtcatctatgttttcttgtatgctattctctaagagtcttatagtttcacattttacatttatgtctttgatccatttggagtaaatttttggggaaggtgtaaggtctttgtctaaattcattttttttgtttttttgttttgcatgtgaatgtccagttgctccagaaccatttgcttaaaagactatctttgttctattgtatttcctttgctcctttgtcaaagatcagttgattatatttatgtgcatctatttctggcctgtctattctcttccattgatctatttgtatattttttcaccaataacatactgtcttgattactgtagatttacaataggtcttgaagttgagtagtgtctgtcttccagctttgttcttgtcctttaatattgtgttagctgttctgggtcttctgcatctccatataaactatagaattggccaggcacggtggctcacacctgtaatcccagcactttgggaggctgaggcaggcggatcacgaggtcaggagattgagaccatcctggctaacacggtgaaaccccatctctactataaatacaaaaaattagccgggtatggtggcaggcgcctgtagtcccagctacttgggaggctgaggcagaagaatgacgtgaatccgggaggcggagcttgcagtgagccgagatcacgccactccactccagcctgggcgacagagtgagactccatctcaaaaaacaaacaaacaacaacaaaaaaaaatctatagaattagcttgttgatatccacagaatagcttgctgagattttgaatctatagatcaagttgggaagaactgacatcttgacaatattgagtttttctgtcaaataatatgaaatatctctttagttctttttaaatttttttcatcagagttttgtagttttcctcatgtaactcctgtacatattttgttagatttatatctaagtatttcattttggggatgttagtatgaacggtaatgtgtttttaatgtaaaattccatctgtttattgctggcatacaggaaagcaattgacttgcatgttaaccttgtctcctacaaatttgctataatcacttgttagttctaggggtttttttgttgagcttttagattttctacgtagataatcatgtcatctgcaaaaaagatattcttatttctcttttcccaacctgtatacattttatttacttttcttgttttatttcattagtcagtgcttccaagagaatattgaaaagcagtggtaagagggaatattcttgtctcattcctaattctaggtaaagcttctagtttttcaccattgtcatgtaaattgtagattttttgtacatatacttttttttcaacatttattttagtttagaatccagatatctatatgtaggtcctgtaaaattctcattgaataatatgcaaagtctataatatgaatactgaaattttatttatttatttatattttatattaacttttattttaagttgcaggaacatctgcgggtttgttatataggtaaattgtgtaaatttacctatctaaaaatatataggtaaacctttatataggtaaatctacataattttatataggtaaatctgtacattatgggggtttgatggacagattatttcattgcccaggtaaaaagcatactacccaataggtggttttttgaatcgctctcttctctcactctccaccctcaagtaggccccagtgtctgttgtttctttctttgtgaccatgtgtgttaaatgtttagtttccacttataaatgaggacatgtggcatttggttttctggttctacgttagttctcttaggataattgcccccagcttgatccatgttgctgcaaaggatatgatcttgttcctttctatggctgcatagtattccatgatatgtatgtaccatattttctttatccagtccaccattgacagacatttaggttaaggtttcatgtctttcttattgtgaatagtgctgcaatgaacacacatgtacatgtgtctttatggtagaacaatttctgttactttgggtaacagaataatggaattgctgggttgaatggtaattctgttttgagttctttcagaaattgccacactactgtgcacggtggctcaactaatttgcattcctatcagcagtgtataagcattctcttttttctgcagctttgccagcatctgttattttttgatttcttaatgatagccattctgactggtgtgagatggtatctcattgtggttttgatttgtggttctctaatgatcagagatgttgagcattttttcatatgtttgttggccagtgggtgtcttcttttaaaagcatctattcatgtcctttgcctactttttaatagagttatttgttttttgcttgttaatttgtttaaattccttatacattctggatgttagacccttgtcagatgcatagtttacaaatattttttctgtttctgtaggttgtctgcttactctgttgatagtttcttttgccatgcaaaagctctttattttaattaggtcccatttgtcaacttttgtttttgttgcaattgcttttggcatctttgtcatgaaacctttgtcagggcctatgtccaaatggtatttcctaggttatcttctgggatttttatagttttaggatttaagtcttaatccataatccatatttaagtctttaatcttgagctgatttttgtatatgctataaggaaggagttcagtttcaatcttctgcatgtggctagccagttatcccagcataatttgttgaataaggagtcctttccccattgcttgtttttaacttaacaaaaacagatggctgtagataggcagctttatttctaggttttctattctgttccattggtctatgtttctattttggttccagtaccatgctgttttggttactgtatctttgtagtatacttttacatcaagtaatgtgatggctccagctttgttctttttgcttaagattgcctctatttgggccccttttttggtttcatataaattataaaatagtttttttctgattctgtgaagaatatcattggtagtttgataggaatagcattgagttggtagcttgctttgggaagtgtggttgttttaacaacgttgcttcttcctatccatgagcatggaatgtttttccatttgtttgtgttgtctctgatttctttgaggagtattttgtaattctcactgtagagacctttcatctctctggttagctgtattcctaggtattttattctttttgtggctcttatgaatgggattgcattttttatttgaatctttgcttgcatgttgttggtatatagaaatgctactgatttttgtactttaaaactttgctgaagttgattatcagatctaggaggttttgggcagagactatggggttttctaggtatagagtcatatattttgcaaacaggaacagcttgatttcttctcttcctatttggatgcacttttgtttctttctcttgcctgattgctctgactaggagtttcagtactatgttgaataggggaggtattcctccaggggaatgcttccagcttttgcctatttgatatgatgttggctatgggtttgtcttagatggttctgattattttgaggtatgttccttcaatgcccagtttgttgaggattcttaagatgaaggaatgttgaatttatcaaaagccttttttagcatctattgagataaccatgtggtttttgtttttagttttgcttatgtaatgaatcatatatattgatttgtggatgatgaaccaaccttgcatcctaagggcaaagcctacttgatcatggtgaattagctttttgatatgctactggattcagtttgctagtattttattgagaatttttgtacctatgttcatcaaggacattgatctgatgttttctttttcagttgtgtctctgctaggttttggtatcaggataatgctggcctaatagaatgagttagtgaggagtctttcctccaacttttcggagtaatttcaatatgaatggtacaagctcttctttatacacttggtagaattgtctgtgaatttgtctgatcctgggctttttctggttggtaggctttatattactgattcaatttcagaagacatcattggtccattcagggattcagtttcttcttggttccatcttgggaggttgtatgtttttaaaaatttatccatttcttctaggttttctactttgtgtgcatagaggtgtttgtagtcatctctgagagttttttctatttctgtgtggtaggtggtaatgtcccctttgtcatttctggttttgtttgtttgaatcttctttttttattagactagctagtgtcctataaatcttatttattctgtcaaagaaccaactcctggattcttttctatgtttttttgtatcttggtttccttcagttcaattctgattttggttatttcttgtcatctactagctttggagtttgtttgttctttctctagctcctctgagtgtgatattaagttgttaatttgagatctttctaactttttgatgtgggcatttaacactataacatttcttcttaacattacttcagctatgtcccagagattctggtatattgtatctttgttcccattagtttcaaagagtttcttaatttctgcctcaattttattttattgtttacccagaagtcattcaggagcacattgtttaatttccatgttgttgtgtgattttgagcaattttattagtattgatttctatttttattgtgttgtggtccaagagtgtgtttggtatgattttaattttctgaatttgctgagcattgttttatggttaattttgtgattgattttagaatatgtgccatgtgaagattagaagaatgcatattctgttcttttggggtggagagttctgtagatgtctcttaggtccattggtcaagtgtcaagttcaggtcctgaatatctttgttagttttttgcgtcagtgatctgtctaataatgtcagtggggtgtggaagtctcctgctattattgtgtggttatctacgtctctccataagtctttaagaacttgctttatgaatctggatgaccctgtgttgagtgcatatatatttaggatattaggtattctagttgaactgatgttcgttgtttattttaatgtagtgcccttctttgtcttttttgattgttcttggtttaaagtctgttttttctaaaattcaaataacaacccctccttttttctgttttccatttgcttagtaaatttttctccatccctttactttgagcctatgggtgtcattgcatgtgagatgggtgtcttgaacacagcatgcagttgggtcatgctttttttttttttttggatggagtttcactcttgtcgcccaggctggagtgcaatggtgcaatctcagctcactgcaaactccacctcccaggttcaagtgattctcttgactcagcctcctgagtagctggattacaggcacctgccaccacgccccactaactattgtattttcagtagagatggggtttcaccatgttggccaggctggtcttgaactcctgacctcaggtgatccacctgcctcagcctcccaaagtgttgggattacaggcatgagccaccatgtccagccactgggtcatgtttctttatttgacttgccactctgtgccttttaattgggacatttagcctatttacattcagggttaatactgatatgtacagatttcatcctgacatcatgttgttagctggttattatgcagacttgattgtatggttgctttatagtgtcaatggtctatgtacttaaatgtgttttgggtggttgctattggtctgtcttttccatatttagcactcccttcaggacctcttgtaaggtgggtctagtggtaacaaattcccttagcattttcttgtctgaaaagaatcttacttcttcacttataaagcttagtttggctggatatggaatttggaatttattttccttaagaatgctgactatagccctcaatctcttctggcttgtggggtttctgatgaaaggtccactgttagcctgatgggattctctttgtatgtgacctgccccttctctctagctgcctttaactgtttttcttttattccaacctcagagaatctaatgattggtgttttggggatagttctctcgtaccgtatcttgcaaggattctctccatttcctgaatttgaatgttggtgtttctaatgaggttggggagattttcatggaggatatctttaaatatgtttttcaagttgcttgctgtctcttcctctctttcaggtctgacaatgagtcatacattgggtcactttacataatcccatatttcttggaagttttgtttatttttctttatttttgtctgactaaattagttcagagaactggtcttcgagctctgagattctttcctcagcttggttgattctgttgttaatatttgtggttgtattctgaaactcttgaggtgagtttttcagctctatcagatcagtttggttgtttcttaaaatgtctattacatcttttatctcatatatcatttcattgtattgcttagattccttggattgggttttgactttctcctggatatcaattgttttcatttctatccatagtctgaattttatttctgtaatctcagccatttcagcctggttaagaacctttgcttagaaactagtatagtcacttggaggtaagaagatagagtaagaaggctttttgagttgccagagttcttgcactggttctttctcatgtgtgtgagcttattttccttaaatctttgaaatttctgtcttttggatgaggtttttttattttatattctctgatgcccttgggggtttgattgtggtataaggtgagttcagtcaactgggttgatttctggaagattttaaggggccaaggctcagctcagcattcctggtctgagtgctttaactctggggggctggtaccaggtccccacacttgttctctggcaccttgaggttagaaaccagctgcactagaaaggccaacgtgtttccagtccactggctacaacattcctgtgggaggtactgaccaaagcacttcactggggcagtggcagtgggatccatgctcacttacacatgctaggagccatggcattgcagagaggtgcacatgcgtcgcctggggcaggatactggcagaaacgagtttgcagcattcttttttttctttttatttttttttttttgagacggagtttcactcttgttgcccaggctggagtgcaatagcgcgatcttggctcactgcaaacttcacttcctgggttcaagacattctcctgcctcagcttcctgagtagctggaattacaggcatccaccacaatgcctggctattttttgtatttttagtagagacggggtttcaccatgttggccaggctggtcttgaactcctgacctcaggtgatccacccacctcggcctcccagagtgctgggattacaggtgtaagccacaatgcctggccaagtttgcagcattcttgcatgcccttgcaccacttgtggaacacaggtggggatggggttgctattgtctgtgtttgcactcacaccaatggcaatggcagcggagggttgagcaggattgctggtgtccatgtgtgcattcccactggcagaaatgactaggatatctctttactttaaagccactgtggaaacccaaatatgcatcctgtcctacaagtcagaacactgttgtttcaagcatcatataaacatttcctggcatcttcccagtacctgcaggtcacagagccacaatgactgctgcagagtcacctagggtttcctaggaaatggagcaatggacatggcatcccagctccttgcacaagaatcaatattctttatcaaggtccgatgttcccttctattcctagtttaatgaagcctttttaaaaatatcatgaatgcctgttgaattttgtcaaatgctttttctgtctctactaattaaccgtgtgacttttatttaatgaattagaataatttacttttgaatgttgaatcatttgtgaatattttgaatgttgaatcatttgtgaatatttgggataaattctactcagttgtgtataattttgtaatacatcattggactctatttgctaatatttgtttaggatttttacatctatgtttataagaaatagtggtgtgtagttttcctcttttttttttctgggtttgatattaggataattcctgcctcatggaataagttaggaggtattccctctgcttctgtcttctgaaagagattgtagacaactggtataatttcttccttaagtgttttgtagaattcactagcaaacccatgtggacctggtgctttctgttttggaaggttattaattattgattcataacctttcttaatagataaattaacaatttcttaatagatacaggcctattcacattatctatttcttcttgtgtgaattttggcagagtatgtttttcaagtccatttcatctaagttgtccattacatctaagttgattttcaatccctttcatctaagttgtcaaatttgtgggcatagagtttttcatagtattcttttgttatcctttaaagtctgtgagatctgtagtaatgttcctctttcatgtatgatattagtaatttgttcttttttttctcttggttagcctggcaaaaggcttatcacttttgttgagctcttcaaagaaccagtttttggtttcactgattttctctattaactttctatttttaatttcattgatttctactctaatttttagtgtctcttttttccaggttatttcagatttaatttactctttattctctagttttctaaagtagaagcttaggtagctgattttagatctttctttttttctaaaatatgcattaaaggctagaaagttccctaaaagcagttttgtcactgcttttatggcatcataaaaaaattgatgttttagtttaatttttatttactttaaaatacttttaaatatttattgagatttattcattgacgtagacttaacactgagttaggctggtgctagagtctgtgctcttaactgctattctatggcatttttaggcaagtcaggtccagtccacctgtaaccctacacatttcacatacatacaaacacactaataaatatgagaagtagaatctgaactgcagaaacgttgtgtattttatttttattatctgtatttttgccttatttcctcacttgaattcaacttctttcaccttgacacactggagagccagagatagaaagacccctcacatatgccagccattgagatcattaggatgatgaacaggacacaatttttatggagagttgtgtggtcaggaggagagttgcaagaaccaagaattatgtgctaggaaatgtgtgttaaagtagagatgtatacagagtgctgtagaaacatggagaaagattacttaactctgatctgggcaagggagagggggcaggaatatcagacaaattttacagagggtgttttgaaggaggaataggagtttgacatgtgagaaagtaggatacggatgtcagtaccctatgcaaaggcactaagacctgggcgaggttagcattctgagtcagtgaagagggtgcatttgaagcatgacgccagagagaagaacagggtggaaggtccagatttcatgcagagtcagcaaataggagtaccttaggtcttgacgtcataaacccaaggatcagacaattttccagtgtcaacaaaagccaccataactgatggaagttaacaagacagggtgcagagaggtatgtaaaggaactgagaagacaagacattggtacaagccagtctccagtttcctctattttcccttggcccaaagcactgtcactagaagatttcatgtgataataataaattttctgtgaaatagtagaagcattatggaggagagcagattctgtgcgaggtatccacctaagacatgcatagccacagcactttgttccctgaaactagagtgaataaataggatgcctccagaaaacaaaaatcatcttcaacaagatgccttttacctatttcttgtcccttttatataatttctggcatatgtgtctatatatagaaatttcctttaattaactaattgcacaaacacacatttgccaatgttttctttaataaacctatccttttctgtgattcaatgaaatacattcaattctgctaatttttcataatgctttccattatgatagcaaaataactcagttctgggaaaatataccaataactatcttgaattgtaacaacagtaaaaatgagaacattttacctgaacaacttgagttttgtgtttgtttgtttgtttgtttgttttcaggtagagtctctctgttgcccaagctggagtgcagtggtgcgatctcggttcactgcaacctccacctcccaggttcaggtgatgctcctgcctcagcctcccaagtagctgcgattacaggtgcatgccaccacaactggctagtttttgtatatttagtagagacagggtttcaccatattggccaagctgtccttgaactcttgacctcaagcaatctgcttgcctcggcctcccaaagtgctgagattacaggtgagagccactgcacctgaccaggagttttttaattgaaatatttgtgcacaaaagcccatgatgtcaccactagtggttaatttatttgtttgtctgactcataatgaatatgagagaattgttttagtaaagataaattgcttttaataaggactaaaatccctttagtttaacacaagccactttattagcagtgtttctgggaaataaaagcaagagttggttcttccagaagtttaatgccagatttcaccaccttcatgagaaatcagaagggtattgttaacatgctgtttcatttgaaacagttttaacttttggtggtcagctcaataaatggaattgattgcttttaacccgggacaatgacatactgtaccaggatatgccgctgtgtaactttcaattctactttttgtattggcaggacttggcaaagaattgcagtgcatgtttccatttcctatctttgactatatatttgttttgtcacttaatagagctacagagataacttgaggaacaaactgactacccaggtctccaggtcaattttctgttattttgcatgaaatgagaaagtcattttgaccctcagaagacaaatcagtgcagattatagatcttctcttgatccccaaaggaataccccaaattcacacatttaatgtaacatatctttattgaacacctaccatgtgctgtacactatactaaactccttagggatatatatacatatatctgagatacggcatcatggtagagagaaaggggcttgggccctagcatatctagccctcacagcttcttactaaataaaacttagcttatctgagcctcagatttctgttcaatggaaattataatacctacatgtacagctattgtggacactaaataacatgaatagcattgccacattgcagatgctcagtacctgttggtttctcattctctctacatcacaagtttagagtcacattggaatgacccacatccacactccaacaagaattcaaaggactctagagcaagtgccacacatatggcataattaactgtggtggttttaggaatcgttggcttgtgggtcactagtatgaagatagttgctgtttcttggagttgaggttgccaggcaaggcttcatgaagttggcaacacttgaattgggccttaagtgtttctggattccagatgtgtacagagaacatgagatgaaaatcctggttggataaaaagtgtgagcagcatcttgggagtaggactacacatgtcactttacaagagctgagagtagactaatttgagtagaggagataatttaggtgggtaaatgggagcagatataattttaagacacatgaagttgagtggacattaaaaatatgtttagtttgtggacattaaaatataatatagttggccctgttgtgtctgcaggttctgcatgtgtggattcaactaactgcagatggaaaatacagtatttgagggatatgggctctgcacatactgagggctgactttaagtagccattggctccacaagacctactgtgggacttcagcctctgtggattttggtatctgcaggaggtcctggaaccactctcccattgatattgagggacaattgtattgtaataaaagtcacaaaagatttttgagttgaggctagtatttttaagaaatctagtccagttttacaatgcagagtgaataaaaaaagtaaataaccagagttttaataatccagaccagcatgaattaggttgatggcaggagcaatgggagaaagaggtgtaggacttaaataaagaattgattggctttggttattgattgtatatggaagtgagaaagaaagaagaaactagtatgaatccaactattcaaggcttgttaactgggaaaatgaggaaggttgaaataatttttgaagataaagtgtgtgcttttagatgtgttcaatttaaagtaattacagggcatccaagtggaaagctctaaacactagttggcatgtgaggggagaaacttaagacacgtcaggaaatcaagatgtgagttatacatcctcatggtgttactaagcacctaaaagaagatgagttttctaaggcagtatttctcaactgtatcttgtattattaaacacccttattcaacaataagtacttactgagacactgatgcgtgtgccacatgccaagctcccatctgtgtaccagggatatggtgggaaacaccaacaaagtccctcccatcatggagcagtcagcacatgatagttgatgtgcatgaaaatgttcaggtccatttgttagctcttacaccgtgtctctcaagagagcctgtctacatggatgtgaagaacagtggcattgctatgaatatagttctaaatgtattctaattcattaagaaagtaaatcattcacaaatattgagaacattgtaaataatttgcctcgacaaccattgtatgtcaacaccttagatgagaagctctgctttaaggagaggttaggaagagagcaaaggggctcaaaactgaaccttggggaatagacatatgtaatggactggaaaagtagccagtaaataaatcaatggatggatggatggatggatggatggatgatgaatggatgatggatggatgggtggatgaatggcggatggatggatgaacaaacaaaacacaggtagacagacaggtaaatatatagattaaaagagagctaaaaattaaaacaaactcatggagatagacagtagaacgatggttaccagaggctggaaaggggaatagagggatgggagagaagttagaatgggtacaaaatatagaaagagtgaataaaatctagtagtatttgatagcacagcagggtgactatagtcaataataactgtacattttaaagtaactgaaacagtataattggactgcttgtaacacaaataataaatgtttgaggtgatagatacctcatttattctgatatgattattacgcattgcatgcctgtatcaaaatattacatataccccgtaaataaatacacctactatgtaaaaaagaaagtgagacagaagtaaagattagagaatttagaggactagaaagagtcaattgaggcagtgtcacagaagctgaggaaaggaaaaattaaggaagaggacacgtttcacagaatttaatgatatagataggtctacagagtgagagttgataagtaagaaggaagcacactgataaaactttgaaagagcagttcagcaaaatagagaagagtgaaggtaatattgatggggttatggaaaataacactcatagggaaaagaaagcacaaaatgattcaaagtctttattggcttatttataagcaaatgacaggttgaatatcagaaacagaaatgaagacattgatgaagatggataaggtgtagttgggagcatacagaatcccagaagttgaggcacatccagcagaaccacctcataataggtttgtcacaggaagtggatcttggggtcaagcagagtaggtcagttcctagtactgaagtttgaaacagatgttctgtcggggaggagagctatcaaccccagtattacatgggagagacttgagaagtttaaaaatccaaccaaagttgtttatggagttgttttttacaatcattttaatagctgggtgaagggtaaattgtatgtagctaaaattttaggcagagacactggtaagatgcaaatctaatgcaaatctaggccaaaatgataatttcgagctaggataatagctatatggatggagaggaatgataagattcttgggcttgatggggccttgtgacagtgaggaatgagagattaggtgaagggaagtctctgtcaataaatatttattgggtacttaagctacagattagtcacacagaaggagtggatttgtctgtgttgattggaagcaagatgaattacgttttgatgatgttgagtcagaagtgctttcaaaacaaacactaagttaaagatgccctttcacaattgtaaataatttggagctcacatgagagataggggttcaaatctggatttggaagtcattggtttataaattcagtttctacccagagagaacacattctgtgagaagagagccagactcaggccacatttaaagggtaaggaggcatagaagagacacatgaagatgcaaaaaatgagccagcagaaaatagtcgtctcttagaggccaagagacaggaagtgtagagcaaaagatacagaagtattagataagttaggagcacacattacccttgaagttaatcttagtaaggacattttcatcccagtagtgagaatggaagctaggctacaaagagatgaagaacaaatggaagtgaatattaaaaatgtttgtatagactcctttatgaaagaaaatcagaagtctgctaagcaacaaatatagaatgaaaacagtagaaagattacatgacagagatgatagaagggtaaggaatgacataagggaaatgcaaaaacattttggaggaagttaaatacaggcttggaaatgctaagtcatccactgttctaacctgctgccttcaaggactgatgtaaagttggcataataatggcattacatttcaagaacttaggatattgtctgacacatgggaaacattcagtttctctattagtcaagatatgcaaaccactgtaaacaaattcctaattttagtagctgatcatgacaaggtttatgtctacttcaggtcacattccaatgtagattgacatgggagctctgctgcacacaatcctttggggtctcaggcgctatgaccagctgtcagacaaggaaagaaagaaaatgtggaagaatatgtgggagggttctttgagacttggaatgctatctgtgatttctgtctttgtttcattggccaaaagtcagtcacatgcctccttctaacagcagggcaggctagaaaatgcagtctaactgtgagccctggaggaaaagaaacaagttttggtaaaaacaatggcagtctttgtaacagcctagtacgatttactgttattactatctatagcagggtcttagtcaaattaattccctgcagaatgaagatgagagagaagacagatacaccttgatggacgctggggatgggaaagttagactcataaacaaatggaagcctaggaagtgaggaagaaacactgccatcctgagaagaaccacaagcactgggaagagatagggcaacattaaaatcctaaagctatacttcttgtccagacttgccctgcatttctgacctgtacagtcaactgccactctatttgccatttggggttctatagataggtcaagcttagcatacctaaaacaactcatttcactccccaacaaaatttactttacatggagcctttttttttttaatgcaatgcatggtgacacctttcttccaggtagtcaaatcacaactcttactgtcactcttgagtcctctctgaccctcatatccagtaaccagttaatcagggaatcccgttagctcaaccttcaaattgtattcataatgtgatcactcggcaccatctccactgctcgcgtgctatcctctacaacacctgtgccatctctttcctcccagtctcctttcaacccagtagtgagagtggtccttcaaaacacaatggaaatgatgtctcatctctgctcagagctctccaatggatcacacctcactcaaaataaatgtggaagaactccttgcaatggtctacaaaactctcagttatcatatcttttttttttttttttttgaggtggagtctcgctctgtcaccaggctggagtgcagtggcgcaatctcggctcactgcagcctccacctctcaggttcaagtgatttccttgcctcagcctcccaagtagctgggactacaggcacacaccaccacacccggctaatttttttttttttttgtattttagtagaaacggggtttcaccatgttgaccaggatggtgtcaatcttctgacctcgtgatctgcccacctcagcctcccaaagtgctgggattacaggcatgagccactgcgcctggcccagttatcatatattacactgcttccgactgatattgcctcacctcacacgctggcctccttgtcattcctcacacatgtcagccatattcctgctctggggcctttgttctggctgtttttacagtatggaaccctctgtcctctgatatgcacgtggctactccctcacctccttcacatctttgttcagatgacacattttaagtggaatctttggatactttcccctgggcaccatatataagaaagcaacatctcccactccaatagctccttaatcccttagtctgctttacttcttcatttctcatagcatgttgcaccctcacacacaagatatcattttcctaattattatgtctaatgtttagtctgactcactcctccccactaaaatgttaaactccagaagatcaggggtctttgcatctagtagaggttcagtaaatactttgaacatagtagaggttcaataaatactagttaaatgaatgaatgagttaataataaacaaatacgttgattgattgattgactggttgattgattttgccttgagccctcatacttcttacattgcttggcaagtagcaatgttctacattttgtgaatgattgttatagtaatggtctgggccccacaatacagacggcagctgaataatttgacactttggtaaggaataaatttctcctttcattaatgactgatttattctattttctttatagtataaatattatctgtgtttcaaattgtgtctgaaaacttacaggccagcaaatggttgggagtggggagcatgcatcacttacagctacagtgattttctgtctctgactcatcttaaaaagccttaattgagtatttattcttatgctgtgagatccaagaaatcttaactgccattaagctgtctacagaagcaaaacaaaatggagaattaaggcaattatcagcatgatatgaaccatagaaaacatgtttccctcaatctggatgtttcgagagaacttatttttgatctaaattatctgagtaatttccccttcagttttcattttattttgcactgatagacaataatttagtatagaaagggacagcccataacatagggaatcagcgtgcgaagaaattcattatccagcatgtgtatgtctgtatcttctatttttactaaactttgttgccagaggagacatttaaaaaaactgctttctaaggaattgttgaaaattaactgatttactgaagttgtgctttgatacctgcctgccttttgacctcaactaaaataactcttcagtttgaatttcttttagctccccttttgggctgtaactttagatccagctttcaaaagccaacaggtaaataaacaggatattaatcatcatacattcatttcaatgagaatgcagccacaatcagcataagcgtgggctatttctgaattacatgaaagccagctccctagggtatgtccaatataactgtgataatgaggaatttgcaggtggacctgctgttcttgtgtaccttattaagtgccttgtcaggtcaattgtatttgtctgatatcttcaatctctttcccctgagatattttccagtaagactatttattaactttaacatttcatattcaaagtagccctcaccccggcctcaaccaccaccaagttctatcacatgaagtaatgacaaagaagaacctgggtaagttgctgcaaggctgggctggctgagttattaggcctctgtagctaaccaggcctgcatcttcctgatatatgaacatttcagcgggcaaagaatagaatccccacgaggatctcagataacatcagccttacccatgtgtaccccaattactcacctcaaatgctatccctcatctatcacttggctatagattcatcagaagaattgaaaatcaaacagaaatattgtacaactttttcaggaagtgatacaagtagacatggaggttacagctagtttgacgcagcctaggaaaaaagggtactggaatgcaaaaatattccccatgtctatgtctctagcagtcaagacctcaatttttcatttttgcttttaaaatcccacttgacttcatcctaacctacctaccatcctaacccatattctctgtcactcctctccattgtgacctttctgcccaaattgactaatctgttttttgatccctgaaaaatctctgggctttcctccctccaggcctctacacatatcttttcctttgcctggagtgcccctcgctgcacttgtgtttgagccaatctaatccacacttcacagtctagctcagaaaccttctcaataaagttctctcgtttagcacagagtaattgcttccatctctgaatccactcagcacaactcactcttctttctctttctcattctttctagatttttaattcttttgattatagaatatcaacttatacaaaaaaataggcataagcttaaatttatagtttgctaggtggttcaaaaaggaatgcctgtgtaactaccccaggagaaaaactagactgttgccagcacacaagaagcaccccagcgtcctggccaattgacaacccccttcttttccaccagagctaacctctgcccttcatagttcatagttttcctatatgtgtgcatccctgaacaatacagtttagttgtatctctttttttcttttaaaaacaattatgtttattcaaaaaaggctagatgaaattaaatcaggctattttaattgattcataatgcaattttaaagattaaaaccaaatattgaaagactaaaatagccaagaaatgctgaattgattagtaaataatatgattagttcaaaatgctcttatattaataacataaaatcattttttctgctgacattgattatagctaagttgacattgtgagagttaaatgcagtttattgaaacctgaaatagttaagttgcctagtctagtaatggagttaaggtcactttatttgaaggtactaagcttactgcataagtaaagctggcagagttatacttgctgtacttgcagttaccaaatttaaatgccttccctggtgaaagagtgttggttaaatgagccctgtcaaatttttgattctggctgcctccattgaagttgaccaagcttgtgggtggtgatgccccaggcttccttgtagctgaagaaaactgaagaaatgaggatactacattataagtagaagagaatacagttgcaaagagacagaaaccaagtatacacacacacacacacacacacacacacacacacacacacacactacacacaaggtgtttttaggtgccgtttcagaagcattgtgtctgtgtatgtgtgaatccttggtttgtgtctctttgcaactttttttaaaattttttatttatttttattatactttaagttctagggtacatgtgcacagcgtgcaggtttcttacatatgtataaatgtgagttgtatctctttttgaagtgtacatttttttatgttctacaaaaaaagataaaaactaaatactaaccactctaaagcacatcaatacattatgtatttggggactttccccagtcaatattacttataacgtttaagtttatggtggtagctacagtccatttatttttattgttgtataattttccactgtgtacatatactacagtttattcattgtatggttgggagatagttagattgctttaatgtttagcaaatataaatattcttgctgtgaatattctttgacatacatttctttccacatcatcacacatttatatcggacacatacacagaactggaattgttaggtcataggtaagcattacctacttttatcagacttctacattttggcaacctggtggtcctgtatcttactgcatttatctaattactctgaagccaagcatttttctggatgactttaggcatctggatttcattcgactgaagtgctttttcaagcacttttctttaggatggtcaaccttcttttctcattgtgagaaaaattgtgaggcaagaattctctctatagcctggatactatttcagtcaatttcgtgtttgtaaaagtcttcagtgattcctatggcttgtcttttccatttcttctggatgtttttgaagaaaagctcttcgttttgaatttattaatcttttttatgtttaacacttaaaagtattttcctatataaggaaatggcaatattcccctatattgtcgtctaattattttaggtatttaatccacttagtatccacatcatagtacagtacaggtagtggtatattttattttgtacatagctattccgttttttccagcataatatattgaaaagactgacctttccccatcagcttctgtgctctttctgctgtatattaaagacctatatatgtgttagtttctgtccacttgtatgtttgtctacatctgtgtaatttctggtgtgctgattatttaaaatatatcttaatatttggcagagcaagtcttaccttttagtttttgtttttttgaaagccttttgactattcttggcctatgttattgccacataagtcttagaattagtttgtctgcttcacaaacaatcttgcctgggttttgattaggattgccttaactgtatataaatttgatgagaattttataaaaatattgggctttataattcacgaacaatgtatataattcatttaagttatttttagtgtctctcaatagagctttataattttttttgtaaaaaccttgcatatcttttgtgagaattatttccaggtgatagattatttttgatactactgtaaataatgtattttaatctaattttctaaatatctgttatttttatgtattgattttgtacaagttttgtatgcatagccttggtaaactttcttatcaatttgataagtttttctgtacattattttggaagttatatgaatataatcatactatctttgaaaaatgacaatttgattctccagttccaattctattaccatttagttttacttgccttattgcacttatttccagtgaaacagtaaagactgagtttggcatggttgtttggtttccagtaaaaaaaaaaaaaaaaaaaagaaacggtgaaactttcatcattttataattttcaaaattagggatgatatttgctctgtaagcttagtagaaaacatttatttcaggctaggttccttctcttcatagtctgctgagggtttctgacatcgtttgctgaattgtattaaatacattttctggatctattgaggttgtgtttttttctcctaatgtgctaatgaacttgtgaagagctgagccagactgagagctgagctgccaggggttcgagtggccatgaagaaaataagccaaaatgaaagtaacagtcaagattttcgtcaatagtgcaatactataagcaagatgctcaactggggaaagcactgacttccctagtgttccattgttcatttggaatggcaccatccatggtcagatagatcagcatagacatgatgaatctccttattgctaagaaagttctaaacaaaaagctccttctgttttatggaccataaacaggagaatgggaaggttagtaatggaaggtattgagtactgagtcagagtgaaaaaagagtatcctcaaagttcctccctctaccataataaggaggtctcagcacctgagaaaaatgtcttctgaagacccccaaataggaggcctctgaatgtaggtaccaggactaagaatgcagacatgagtaagaacatggccagctgatggcacctgagtccctgactgcaatactcttcaaagactgcagtgcattggctgtgcaccaaagtaggtgtggggaaggtggttttccctgctgaggcctctcaggtaaacgtttggtaatcacctatggtcaggcttgaaggatcacacataggttttcaggcagtatcgagagtccttagtgatgaatgaagatgactgtgtttaatgccaaactaaatttgaattcctggatgaacccagtagtaacatgatacaattgatgtttttaaatagtattgttatgtttattttaatgtgtcagtaatattttgtttagggctcttgtattattgcttgttgatggaaaatcaatggacttttgtatattaaatttgtatcccgcatctttgctacaattgcttattatttccagaatttttttttgtcaattctcagattttccacggagatgatcatagcatgtatgagcaaagacagctttatttcttcctttccaatttgtatacccttatttccttttcttgtcttattacattaactagtacttctagtacagtgttgaaaaagagtggtgagaggggccatctttgccttcttgacattagcagaaaagctttgagtagataatacaattttgtttcttttttctagttttctttttaaattctgctatcctgttttatagggttttgtcctctgcagatatttttaagtttttcatttattcttataaacagggtaagcatagctcttttaaaatgtgttctacaaatcccagtgtctgaagtgtgtgcagatctctttctgctgtctgccatgctagttctggccatgttatttcctttcttaatgcatctgcttatatatgactgcttcttggccattgcccttaaaaataacttgggaagattccttgaggtctaaaatatacctcctacaaagaatggggcactgtcagtctgggactacttcagtcaaatttggtgacttaaattccatcaccagtccaggctctgagttcaaatacatgaaagagccaatcaatgtccacaatcgctcaagaaattttcctctttccttccttccttccttcctcccttccttctttcctttctttctttctttctctttatttttttttctgtcctgcccactcatcaccacagaaaacttctctattatcccctcggatttggggcttgtggtggaatataggttataattagttcagccttctttcaaaatgtagcgttctgaagcttcaaaaggaagtgtttcttataagactcccaccttgggtaggccatggacattgacttctgttcctctcaccacctatagctctgaattgaaacccatgtgtgcagtattgaccagtgacttcaggacataagtatctttgttaccttaatattccacttgtgtctagttacaggcttccactcaagtgtattccaacattgttcatattttattaagaagtctgatctgaataaatttgcccaccattattctaaatcaagacccaggagaaattttctctaatgatattttgacaaacacgtatatactgtgtggggaggtggagggctatagtaagaagagcaggctttaatcttcgttccaccatttgccagccatgtaactttggacaagtcagtgaagacattcaaaccttggtttactcatctataatataaggaatatagaattagtgacaataaatacaaagcatagctttgtatacaaattatgtatacaaatacatagctcttaccattattattttcatgtctccatgacatttttatatgttcttgacttgaactttaattaacttttggattaataatttgtctgttttaacatcttgctttcttaaggacaatggaatatcttaaattgttttttataatcctctgtattagctagcatagagtaagtacttattaattttttcagtttgttcaatacatccagacacttgctggtctgttatgaaagagtatgaaactttttgagtgattatgtgcaaggattctcaatcacttgccatcacaatagccattttcactttctttatagcacttgtcactatttgaaattatatttctctattatatatttacttgtttgttccaaatagaatattaattttcctccctaaaatttcggatctatcacaaagtgggtgtttaatggatatgtattgaattaaaaaaagaataaattttacaggaatcaaggagtgggagctttttgtgacattgacttttcattggtatttgtcatctttctcagctcctatacttctggaaaatatttattcttaatttggctaattgttttatttattgagaatataaactttccctgaaggctaaagtttggcccaaagagtgaggaaaatcagctgttacctgtgacatgggttaaaaatcttcttacaaaatgagaagtgattacacatgtagggctttttcattacattaaaacaataacagtcctgggaatactgactatcgaaaggcagaagaaggagactagacacctatctctcgctacatacaaaaatcagctcaaatgattaaaggcttaaataagaggctcaaaactatgaaactaccagaagaagacacacaggaaatgctttaagacattggcctgggcaaggacttttaaaataagacctcaaaagcacaggcaacagaaacaaaagtagacaaataagactacattaaactaaaaacctttttcacagcaaaggaaaaacagagtaaagagacaacctacagaatgggaaataagatttgtaaactatacatctgacaaggagctgataccaagaatatgtaaggaacttaaacaattcaagagcaaaacaacaaatagtccaattaaaagtgggcaaaagacgttaatagacattccttaaaagaaggcattcaaatagccaataggtacatgaaaaagtgctcagcatctctaatcatcaggaaaacacaaatctaaaccaccatcagataccacctcactccagtgagaatggctataattaaaaatactttttaaaacccacaagtgttggctaaaatgtagagaaaagggaacacttacacactgttggtgggcttgtcctcgagaaaacgtagttttcataattttaatttgacaaaatttttaaaatcctggaaatagtaaatatgttacccttcaataaacaacaactgattaatagcttgggtaagagttcagtacatacttctagctacacaggaggttcctcaaaaaaaaaaatatagaaatacaatataatccagcaatcccattacttgtatactgtatattcaaaggaaatgaaatcagtatgttgaagaaatatctacattcccatgtttattgcagccctgttcacaacagccaagatatagaatcaacccaaatatctaaaaatggatgaatggataaagaaaatgtggtatatctattaatcaacaatgaaaaactatttggctattagaaaaaatgaaatcctgtcatttgggacaacatggatggatctggaggacagaacaaatacctcatctgtggaatctaaaaaaaacaaaaaacgacaacaacagaaaatattttaagaggtgtttttttgtttgtttgttttttgtttgtttgttttatcacagaagcagagagtagaacagtggttaccagagatgggaggagttggggagaagagaatgggagagattggtcaatgcatacaaaattgcaattaaaatagatgaataagatctgggattctattgcacagataaacaataagatatgatatattacaaaatagcaagaagataagcttttgaatgtcctcaacaaaaagcaatgatgaatacgtgaggtgatggtcacactgaatgtctggatttgatcatttataccacatgtatatgtatcaaagtgttaaaatttaccccaaagttatgtataattatgatgtatcaatttgaaaacaaaataaaaaattaaaacaataacatgattcaggtactaatgtttacccacagtaaaagtaacattttattactttatcataacatgtatattgatatttgaaagagaagaaaataataacactatgtagctagaagtatgcactgaactaactctttcccaagctattaatcagttgttcattgaagggtaacatatttactatttccagggttttgaaatttttgttaaattaaatctatgaaagctatgttttcttgtggacaaagacaagagatgcttcccttttatcctcttctaagaatgccctaatattgtctctaggatttaccactttggcacgttagttatattgtttgagcataaattgctaagatgtaacagaaaactgtagctttgaaggtcctacataaggcccacaatatactatggaagcctcttcttggttcagaaattctctcctgaccagaagatccaggaatgatataatgagaaagtgtcataaaagtgggggaagagtgacacaaaaaccagctgcaacccatcctatctaggttgcagctggtttttgtgttagatgcgtatgtcagaggttttttttttcagtcagtgtacatcaaatgtgctgtgaataaaagaatgaggtacatggcttccatttctattactctccactctgtaatagaaaagctgaaattatatcaaggttccataaattcccacagttctagaactcggactgacatctttaacttggagtataattatttagttcaggctttgtcacctagttgattataaatacttaatgcgtacagagatgtttaatatttgcattagagtctttagtttgcaaagatcttcacaaatatctaatcttcagagcagctcttccctagttaatctgaactcaaagctgcttaggttataggtattttagtattttcaacccagggaaaatataccagtttccttttaggaaccctttaaactacctaactgcaacctttattattattattattattattttgcaggggagaaatagttgggaagaaaaggttagtctatagtgttattcccataatcaattagagataaatcaaaacccctgctcctgtcaagacaaatatgtttctctttagttgtgatttctcttgtgtcagtggcaggaaaagaatcatacaaaccacatacacatgaatttctgttccagtatgagcagtccaattacagaacctgcccactctttgtaccagtttctctatcaaaggtcctgactttgaaggttggtgattcgctcactatgcaagattatctttttcattgcatggtttcttctttagtgaaaaatctctgtttctgagcaaatgtcatttcttgtattaaactttatagctacccctctgtgatgtgatattccatttcgctggaatcacttgtatatttttttattatgtcctctcccaggaagctcatctaaatcacagtacctcaccaagatttgtttctctcataattgttcctacttaattactgtgtgcacattggacccttccaatgtgctgagccggtcttagagatgagaggatgaactatgaaaataagatttagcatatgaagagaataaggctgaattagaatgggagagggaatgtgtttgtatatgtgtgtatatttatatatgtatgtatatgtatagattatacacatacatatatactttgtaaatgagaaatttatactcttttgcaaagcaaatgcagttgaccatgtgtagatcttaaggcaattttttctgggacgacagcatatatggtattatattaattttttaaatatattttcaacttcttattttagattcaggaggtacacgtgcagatttgttaaatgggcacattgcatgatgctgacgtctgggatacaattgatcctgtcatccaaatagtgagcatcacacctaacaggaagctccgcttccttccccacccccagtagtccccagtgtctactgttgtcatctttatgtccatgagtacccaatatttagctctcacatgtaagtgagaacatggagtattaggttttctattcctgtgttaattcacttagtataatggcctccagctgcatccatgttgctgcaaagtacaagatttcattctttttatggctgggtaatattccatggtgtatatgtaccacattttctttatccaatccactgttgatgggcatctatgttgattccatgactttgctattgtgaatagtgctgcaatgaacatacaagtacttatgtctttgtggtagaatgatttactttcttttggatacataccaagtaataggattgctggattaaatggtaattctgtttcaagttctttgagaaatctccaacctgctttccacaatggctgaactaatttaccgttccacaagcactgtataaacatccccttttctctgcagcctcaccagcatctgttgttttttgactttttagtagcagttgttctgactggtgtgagatggtagctcatcgtgcttttgatttgcatggctcacatttttaaaggaatttgtaataaataaacacttgcaagtacctaacaacttgaatttaaaatatatgaagtaaaaatggtcagaattgtagggaaaagttgacaaatctataatcatcacaagatattttagcacatctctccgaaaatctgatagatcaagcttataaaaaaatgtaaaaagagagaagatatgaatgactcatgtaatagttacttaacatacataatgaatggtataaatcaaattactgcatctatcttagtgctacaggcataacttgtaatagatatttaaatgtaaagtattacttattgaaaagtgaaatagcaaagatgttttctctacatgactcccaactaaagtttgtttctttgtgtttttatctttccttttacatgtagccaaaaatcacggtttctttaggaaaaaaataaatcagcaaaattggttcattaacattcataaagagcttagtctaggccaagcgcggtggctcacgcccgtaatctcagcactttaggaggccaaggtgggcagatcacctgaggtcaggagttcaagaccagcctggccaacatggtgaaaccccacctctactaaaaatacaaaaattagctgggtgtggtgacccatgctactcgggaggctgaggtaggagaatcatctgagcctgggaggcagaggttgcagtgatctgagatttctgtcgcccaggtttgagccactgcactcaagcctgggcaatagagcaagactctgtctctaaaaaagaaaaaaaaaaagagcctagtctaacttggttagaaagaatctattcaatcttttttttttttttttttaagtgccatctaaacagaacccatctcagtggcatgttgttgccctggccattatgtataccctaaagaattatatttcaaatgttaatctatgttagaatcacctggagggattcttcaaacaagattgttgggcccaagatggggcccaggagtttgctgggtttttttttttgcaatggaatctagctctgcctcccaggctggagtccagtggtgtaatcttggctcactgcaacctctgcctcccaggtttaagcgattctcctaccttagcctcctgggtagttgggattacaggtgtgtaccaccacagccagctaatttttgtatttttcatagagatgaggtttcgccatgttggccgggctggtcttgaactcctaacctcaggtgatccacctgcatcggcctcccaaagtgctgaaattacaggcatgagccaccgcacacagccaggaatttgcatttctaagaagttaccaggagacagtgatgtttctgggttgggagccatgctttgggaattgttctagagcacatgagcataaggctgctaagtcatcagaattccccatggtgcatttcagatgtgggttgccatgagtcctgagtgtgtagaacaaagcagtgctttaaactagaacaacctcaaatgtaagaagaagtttaaatatgtaatccaacattggagagaacagtcataatgtgaactgtaaagagaagcttgttgggtagcttccaaaaatgagtagattttacatttcagattatgttacatttccttcatcactaaagcccatatgcacgtgcactggaatatactctaccctctgattcctctacaaagggctcaaaaacctcccaggcaaagctagttctttctccatgcttgtctcattcatgaataacatcaaacaatattgtacaatgacttttgccatatgtttctctattaaactggaagacccttgaagggagagagatttgattttgattatcatgtacccaacattgtgcctgaaaacatgtgcactcaataaatgctgtggcatgaaagcccttcaagagcaaaggtattaaattgtccatcatcagtcaacatgtcttcctggcactgggtggagtgcctcatactgaattaatatttattggattaaactgaaaggaaacagcaggaaacaaactctaacctcttcctgtattaggtaccaggaaaaaataaatccccaaagcaggtatgatcttgtttcctgttgagccactccaaatgggcagataaaaccatctgctcttggtccaatgtagaatagatggtacctcaggttgcagggagccatcctggttatgccacctctgtccccttgccacattgtccacacaccatccctgctcttggtccatgcattttgtgttgctgttccttggtaacctctgccactgcctatgacagcccgccactggtactatgttatgcaaattgccagcctcaatacaaaccctgtctatgaagaggcacttggttggcagagtgaaaacacagagtaacgagatgccatctgcatttcctactacatagctcaattagttgattgatttgtaacactttaaaaaacattttctaggcaaagcacattaggagagtgttttataatgtattcagtttaattaaaactgcactaagtggagtactttgcttcttggtttgagaaaaaaaaaaatttacaaggaggtcacatatcatattgatttttaaccccctaagcaggagtaaaataacattgttaaaggttgcagcatctagagccacacaagtgtacctctttaaaaggtttgctgtaattagaatagagaagattggttagtaagagaaaacatgaggatgccgtcataaaatgggggtgggtaggtaaaggagggaagctggtaacatgctctgaatttgaataaccaacaacacctgctcctttttgcacacaaaaatgcttttatcatctgaagggggaaggaaaaacctgcaaccattccagatgaattcaaggcttaaaaacaagttagaaatgtttaatgtctatgcaagtctttactattaaggtgagtgcattaaaaaccttttggtaggacagttttccaagtttggataattttagatgttaatctggctcctccctttcacatctcagatcgttgttaccaggctgctttctcctcattcccactgcctgtcacattaccaaatgcaagcaggcttccgaattgttagtcagctgattaaaccctcaaattattggagacatttgcatgggtaattatgatttatttaaaagcactttgtttgcattgctcttgtctcagtttcttcaaagccaattactgaaaaattgattggattggtttgatttttgaaatcatttggaacttcagaacacatccctttgcataatttttttgaaagtaaaaccaaaacaaaacaaaatggaaggagttctctttgaaaatctgtatgcttcatgtctttggaacttctgtagtatgcaaataagtggttaaaattagtagtagaaacagtaatagttatttttcaatagaaggagagatcagagtaaatcagttaaattcactgtttcagctccatctcattttgcaaagttacctgtacttagtagggcaatttttttttttctaattctgttggacttctaagaactagaaggattattagccaggatgctggcaataatactgccctatatcaaaggagattatttttctgatgaatatgttgatacttcattatttaaatcctcttttggaagaatccaaaactgaccaatctaatactgaattctaccatctactgtagaaaatacctccatgagtgtcttagtttaagctactataataaaatacaatagactgggtgatctaaacaacagacatttatttctcatacttctagaggctgggaagtccaagagcagattcggttcctggtgaggaccctctttctcattttcttctcactgtgtcttcaaatagataagagatagagaagagagagagagaaagaactcttacctctcttcctcttcttataaggacacaaatcccatcatgggggccccatgctcaagacttcatctaactttaactaccttgcaaatatcccacatccaaataccatcacattggagttagaacttcaacataagaattttgggaggacacaatcatttagcctatgataatgaggttctgactttgtatctactccttcccaaaccatgcccacaaaaagtctcaaaatattgcctttggcttatccattcactttttataagcgattccaaaacagaagatacaattaccattggtttcttaggatagacagttgctttaaaaatattgtaagcaaataattgttgggtatttattacttaaaagttaataatttatgtataaattaccaacagctcatttctatatgataagggtgtctcagaaagacattttggaataatacattcctgtaattctttttttttttttttttttgaggtggagtcttgctttgttgcccaggctggagtgtagtggcgggatcttggctcactgcaacctccgccttctgggttccagccattctcctgcctcagcctcctgagtagttgggattacaggtgcccaccaccacacccagctaatttttgttttttttagtagacacggggtttcaccatgttggccaagctggacttgacctcctgaccccaagtgatccgactgcctcagcctcccaaagtgctgggattacaggcgtgagtcactgcacccagtcttttttttttttttttaagaaactgggtcttgctctgtgcctcaggctgaagtgcagtggcacaatcatagctcactgcagcctcaaactccttggctcaagcgatccttcttcctcagcctcctgagtagctgggactataggcatgctccaccacacccagctagttttttagtatttttttgtagggatggtgtctcaccatcttgcccaggatggtcttgaatgcctggccttaagtgatcctcctgtctcggcctcccaaagtgctgggattagaggcatgaggcactgttcctggcctaattcggtttattaaaggaccccaggccgggcacggtggctcatgcctataatccctgcactttgggaggccaaggcaggtgcctcacaaggtcaggagttcaagaccagcctggccaaggtggtaaaacctcgtctctactaaaaatacaaaaattagccgggcttgctggcaggggcctataatcccagctactcaggagactgaggcaaagaattgcttgaacctggaggtggaagttgtagtgagccaagattgcgccactgtactccagcctgggtgacagagcaagactccatctcaaaaaaaaaaaaaaaaaaaaacagaaatggaccccatagtcattctatccttccaaagacaaagatgttcaaagatgcctctgtgggaacccgttaattccataaggagcgttttcactaagaatataatgaatccatgccaaaaaagaaaaaagacaatatagtacttatgattttatatattactaatggaactggaagtaaaaataattactatttaattacagaaatgtgtactccaatgcacaaatgcctgatagaggataatgacgttggacaccaaaaacgttctgtggctgctggggacatttggcaataatttacatgtttaattgagttgctgtgaaaggctcattgtgcaattacatgttcacttaggtgctcagatagatactggaaatgcctaggtttcacttgtacctatttcccaaattgcgcctgcaacaaatgtgtccatttgcttatgtgggactctacatgtgattgcactctaccgggagtttaaagtgccttctgcccttaggtttgatggctcagtcttgctttgagcactattgcgacgtagactatttatgggacaatattgccctctggcagtgaggcagccagtggttttaataactgttttatgtcattttgacagtttttaaactagtcacacccagcagtttaggccagaagggaaacatcagtgaatgcctacaggagttttctattacagaactcgtacatgcatttgtaccaggaaaatgctacaattcttgctttaaagcaaagctgcctttcccaagaggagaactgaatttttgccgcgtaaagcttcagaaaagtgcaaataataatgacaatattgtgctcacaggacaaacagagaatagaaccattctccctttgagaaattcatgactggagtgccacaaagatcaaccccacgtgagccaatcacaaaacatcttcctgtaatgcatgttcagacactcgtgggatcaaaaaaggacctcagggtcatatctgatcctttggattgaatcatcgtgaggagtgtctcggcttcacgaaaatgacccagagctgctcgctgaagctggagaaaccaaaggcttgacagcagctgccaattcctggaggggtatctcagctgcttctcagccacttacgcaaagggaatgcctcaagagagccaggtgggctttaccagatggggctgaaattacagggagtagaggctctgctatgttgagaagtgcagcttcggcagacagctgagaaagacacagctcagtaggcacctgcctttccagcccagtggctgctgcaggaaacatttctgggatcacagaaggcaactctggatctcatcttggtcattgggacaggaaaaccaggcactgcacggcaaccccacgcattccttccttgcttcccactgcggaataggtcatgcatctctgggggcagagtgcagggagagagggcaggaggactccccaggagagggaggagaagataaaagtagcaatttatgcttttacttcaagcatgcacacaccgacatctagcaaaatgcctggaagtaccctgcacactgtttttcagctcatatttcctgagtgaccttatgtgaatggacacagacactgtggttcaaaagggaccaaattcgcaattctatttcaataaaacaaaaattagggattttgaagttaagatgagatatgaagaaagccaaaaaggaatattaccacagaaggagaaaaaacaaaaaggctagattcagaaaactgagtttaaatgaaacctagaaaggaatttcagactctgcatatattgaaactatcaagagtccataacatgaatgaaatatactgcgtacagtcatttagataaaagtgttttttgtttcgttttattttgttttgagacggagtctcactctactgtccaggctggagtgcagtggtgtgatcttggctcactgcaacctctgcctccctggttcaagtgatgctcctgcctcagcctcccaagtagctgggatcacaggcacgcaccaccaggtccagctaatttttatatttttagtagagatggggttttaccatgttggccaggctggtctcaaactcctgacctcaggtcatctgcctgccttggcctcccaaagtgctgggattataggcctgaacctctgtgcccggccaaaagttttgaatttttaaaacttatcctgtttaaaaataagctaaattattatcactcaaatacaacctcagtgcaaaagggaagaatttagcttagtaaataattaaggcaattgttttaattgtgcaagagataacaaaaatcgcttcaatgatctgatcaattgagggggagaaaaaggctattaaagcctattttaaccatcaagagtatgtgttacacgtatatccacattttgttataggcaaaattcaagaacattaagcatgtcactgaacatgaaactaagacatgaggagacagggttggggctatggtgtggtgactcagattttacagaagatccaatccagaaaagctagagcgcttttccccaaaatatgtaccagtctcggccaaccgctcaatcactaagccttgcaaataacctattttccaaatgatttcaaaagaaaataatgcctgccaaagcaaagcaactcattttccccagtaatgactgcaggaagacctttgatttccttctcagcttctaaagctttctttaaatttccctatttacacacagtgtttcacctcacagattctcctttcaacagctgtgtgggacaggaatgatgcccaaggacatgcagcccataggttttattttgttttctttgggtaattttttgggcagaggtgatatgatttctatctgaagcatttaaggaagaaattgagtatgccaattttgacagatgatagaataaaagccccagctatttctaggtttgaataataataataatggaaataatggcaataacaataacaatgataacaagtgccataacttcttaggagaatactacagactactgttcatacattttttcagtaatcacagaaatcctgtgaggcgaatgttactgttttcatcttactcacgtggaaagtaaggacaaggcaggtgacattgattactccagggccagagctagtaagcatttgaactcaggtctgtctgccctcaattccatgtttttagaccttgtgctactgttatttcttcagattaaaagatgcataggtgggctctggtagacaaattactaaccattctacctaaacctccctgttcctacaccctttgccatgtgaccttggagctcctcccactaaaggagcaggtctgtttccccaaccactttgagcatgagtttgaccatgtgacttgctttgaccaatagaaagaagcagagttaacagcctccttgtggctcttagtccaggctttcattggccttggtgcagctgctcatcctcttgcaccctgttatggctatgagaagaatattcctggccagtctgctagtcccaggagaggggtgagggacatgtaagataaaactgttctggtgacttgctaataaccaaagaccatccagatattcatgagcactactaaacgatcattgctatctgagttttgtcattgcttgttacaattactgtaccatctataaggtctatttgaaagaatatgtgcccaatgagtgagtgtacgggcacatgcacaacatatacacataccaaatggagtggaagtcttggtgtcttacatccagataaccatttggtgagaataaattcattaacaacaacggtaagggaatttcagtattttggttttcctttagaaagctgtaaccattctatttgctgctcagttctcttgttaaaagccaagaggatgttttcagacagtgtagctgcttagctctggttttggtctttgatgaattttacctgataactgatacttaaagggaccctctgcgcaccgccactgacatatctcagtaagagggagacatcttgacccctgaagggcagtgacagttcagtgctcctctgtcgagcccatcctgattgcgctcagtggcagaaccacccgagatggttttgactttgaacaacatcagcagtgagttgaattgggaagtaactttacaacatcaaagcctgccatcaagtggtatcatatcattttatgatgtaagacaccagacaaaggttgaatgaaggaaaaagaagtgtggtgtgcaagtatatattcaccacacacacacatacacacaaacatcacaggcatttgaaggtgttctcagattgtgactaggtgaaagtgttctttataactttggcttttgatatatttacctatctggcactagcaatgaatatttgatacagtcatagctacatgcttagactatgactaagtataatagaagaagtggagaactggcctaatatggacagaaatcagatccaaataatcttgccttaaaaaaaaaacacagatttttgtctcaatgttctatttaacatgctttctgctaactcaactgagaaaattgaatttgggtcaattgttacaaatacagaccaatgcattcaaaggctgtgtagtttcatggctaattgattctgtttaggtaatatttgcaagaaaattacttttataatgcatgaataaaaagatacatgttatgatagttggaaatctgtgaaacataccctaattttctaatatcaaagtaagacataaatatactttgatttgagctagatttttagcaagatttgcataatttcaataacatattaaagagttacatttgtaagtgggagggttgcagggtttagaaccaaactggaagaaaggctggaagtggccagccagttgaaacaaagccctgccattccatagaagagaagtgtatgatgaagagaaagctggctgtgctgtgcaccattatctgccacttttgccttgttaaacttgccactcaatttgatatgacctagtgtttatgttctattttgaagttcttctatgtcttctattttatattatttttttctgttatattgatctgattaagatgaacactgtcacatatcattagcaagttctgattacttgaccattagaaagaatatttatttgttctgttcatccatttaataccaccttgaaattcatagttttctacagggatgtctaataggcatcttaaaattaactgtctaaaaggaactcttgactccttcccttccaccaaacctgttttgcccagcctttcccgccatcataaatggcctcaccattcacccatttactcagacccaagcctagggattgttcttgatttctctccttcccttgcactccacctccaatccatgtgccagccacctaccagttttattattaaaatacgtcttcttccgatgccaccaccatagttcaaaacatcattgcctttcatctaagctgctataaaagcttcctgatgggttttcctgatttgactctttccccttatattggattctcaggcagcatccagggtgagtttttaaacacaaaatcagatcacagcaatttcttgctcagaactctccagtggtttccaagcaccctctgaataaagtctaaatttctcatctcagcctacgatgacctttatgatttagtccctgctaatctcttggttttctccttctgctctctgctcactctacccatgctggccttcctgctattctccaaatgtcccatgcttgtgtccacctcgagccttttcacttgctgttccctctgcttggaaaaccacacacaacccccggtctttgctgccttgctctctcacttcttctagtgacatttcttctcaaatggcacttcctcaaagaggtcttgtctagctaccctatcagacatagccctccatgctctataggctcttaccccttggccttcattgcagtgcaacctgctatccattgacagctgggttttcctctcgaagaaaggaattctggatgcaattgctagcttttccttattattatttttaatgcaaacaaaacggcctctgctgccagttcaaatactgagctcagagctctgttctttcctgctgaaatttataattctactcccattcttctggttctccttgccttataaacaacaaacatgtgaaccaatgtgacttctatattatactgatgattcccctatttaccaataaagtgtgatctaattttcataacagaaacattcattattgaacggtgtattgttcaggtttgtaaatgtgtagaaaatggcacaagcaaactgaaatgatacatgcaaatctattacggtgggaaagaatatttttatttttcaatctataaatactatgattatccttcatatactgtttgcatatatttatgtgttttttgtgttaaagagggaaaacataaaaagttaatgagatcctgaagtgaaataaagtgaacatatttacaacagcaacaagaaaggaatatgtcaagatagacatatcacagagatatatacacatgtgtgtagataagattggtgagatagacagataatagagcttgtacttggcctgccttcacccaatgttgcaatgacaatctatacaatgtaagtatttgtactttttatactttcaagaaaagcagatataaaattaatgcatatactttttgtttttggcatcctttcatggaagcaataaaatattctggagagagagagaaagagagagataaactaactcagggatgtgagaagaagaaaataaatatcactcttactcctccatctgaagatgatgatggaaataattgtcatatttctcttatgttttttatttgttttttctcccagccaagtatgctttttagtgtgggtctctgtgtgttccctttggtaatgtctaataacatttctaacctggagatttatttcttagaagcaaagttctgctcatcacaagccatctccatcagagccatttctccttatggtttccttctcatcatttaatgcttagtacttcttcacaatagaagcaagctgcctttctaagggatgaactgatattctagctagaggacttaatattccttttcagaaattgagaggttctctttgcttttctaggccttaattaagtgattggttatttcataaacagtcagattacatttaccactcacaattgtcaaatttttaaaactcaagtaaactttttttccttcttcaaacaagtctcttattctctcctgaagttaatggcgggcattactaccagtttcttggccagctgctaaggagattcctttcccttaaaaagttaaagtatttaagaatcaccctcaaaccccaggaagggtggtcaacaaaaaaagatgtcttcatggtcaaactttatggacacaacaagaatcccaaagaagggagatgactcaagccatcttttattacttagacgatcgatggcgatgatgtggaatttgcaacaattcttttcttgagacccagtaatagttaccttttgctacataacaaaccgcctcatagtataatggcttaaaaacagacatctattatatctcaggactcttagcttggagttctctccatgcggggtctctatcctcaactggctggcccaggcttgttttcatggtggcagaagggatccacctagccagagggcgagcccccttgcacaacacttttcatgtctctgatcgtgtaagatttgctatcgtcccactgaccaaagccaattacgtgttcaagctcagattcaaggaaggagctctcacttctcagggcagtgctgccaagagtttatgtacacttcagcaatctatcgataccacaaatatgagaggccagctttttctcttttaaaaaaataaagcttataaaataacacaagtacataatttccctacacaatgagtaactagattttatgttttctctttcggttttcctcaaaaacttgtatagatcatcttttgagatgaatagcggagcccttgtgatacaccacattctaagaatgctggggacactgtattcaacccaggacagctgcctaaggttgtatagtctgtgcaccgcatgatgcaggagatgctattcatgccatattcctaaaattttgtatatttattgcaataatttcctggcaaacaatagttacatttctagagagaaggactgctttttctgattcttacaaaaatgacttgttgatttgcaactcatgctgacaagccatcctttcttaaatgaagaaagacttgtttaaccaatggcaaagaattctccaccttgtattgattatctttagcccctcatttcttctgccttgaagtgcatgatttttcctgttttctagagtatgaagtcactttagtcttaagtcttatagattgtgttagatcacattcatgtttacaagccaaatatttcacaattttcaagtaccttgtattcattgttaattttccaagtctgaaattgtttctctctggactcatttttatttcaagttctactctaaatgatttttctttttctgtttcactacataaagttctttcttcctctcaggggatctctgctaatccctttaaccaccgattgccaaagacattcacaacccctgtgttggcttatttctttgttaagtaaaattttttcatcctttgaaattgaaaacctgaaacattttttcttaagtctatgaccaaccattatttataaagctgtatcatatcttagaattagcatattagcatcagttgcaaaaaaaaaataggcaatagagaaaataaaagatatatgtatatagcatgaaagttactgcaaaaagaaaatgaggctgtgtgtgtgtttgtgtgtatgtgtctgtgtgtgtgtgtgtgtgtgtagtcgtgcatcgcttaacaatggggaaatgttctgagaaatgtcttgttatgcagtttcatcattgcacaaacatcatagactgtgcttataccaacctaaatgttatagcctattacacccctaggccatacagtataacctattgctcctaggctacaaacctatacaacatgttactgtactgaatacagtaggcaactgtagtgcaatgatatttgtgtgtctaaacatagctcaacatagaaaagatactgtaaaaatatgatataaaaagataaaaatggtccacttgtatagggcacttaccatgaatggagcttgcaggactggaagttgctctgggtgagtcagtgagtgagtggtgagtgaatgtgaagtcctcaaacattaccgcacactgctgtagacttcagaaacactgtacacttaggctacactaaatttacaaaaaatatttttctttcttcaataataaattatttactgtaacacattttactttatgatttttaacttaattttaactttttgactattttgtaatcatacaatttaaaacacaaacacattgtacagctatacaaaaatattttatttctttatatctttattccgtaagcttttttccatttttaaattattaattttcatgtatgtatttattttcacttttcagactttttcgttaaaaactaaaacaaaaatacacacgttaccctgggcctacacagggtcaggatcatcgatgtcactatcttccacctccacatcttgtctcactggaaggtcttcaggggtgatatactcatggagctgtcagctcctgtgataatgataccttcttctggatacctgaaggaccttcctgaggctgttttacaattaacctttttaattagtacaggagtacactttaaaataatgataaaaagtttaatatagtaaatgcataaaccagtaatgcaatggtgttttgttttgttttgtgtttttttgttttttttgagacggagtctcactctctcacccaggctggagtgcagtggtgcaatctcagctcactgcaacttccgcctcccgggttcaagcgattctcctgcctcagcctctcgagtagctggaattacaggcgtgcgccaccacgcccggctaattttgtatttttagtacagacagggtttctccatgttggtcaggctggtctcgaactccgaacatcaggtgatctgcccacctcagcctcccaaagtgctgggattacaggtgtgagccaccacgccccacctaatataattatttattattaactattatgtatgtatataatcatgctagacttttatgtgactggctttgcagtaggtttatttataccagcagcaccacaaacgcatgaataattgtgcaatgataatagtgcacatgagtagttgtgctctgacattatgatggctatgacattattagacaataggaatttttcagctccattaaaatcttataggaataacactgaatatgcagtccgttattgaccaagacatcattatatggcacatgactatatatatccttaaagttattatgaaaactaacactgaatctccatatttacttctcttcgaagagtttaaaggattctaaaatttgtatttgagagtgagtgtgcaagaaataaggaaggtcagaaaagttttacatttgttaatctcatcctgagagtattttttgtaaattaaaaatacatgtattttcatcaacaactggctcacattccttaaactattaaagttcccaggtagacacacatgcatgtgtgtgagtgcgcccccccacacataatgatgtgttttagttttgcatctgaaggaaaggaatgctaggttttcttgcccataaatttatttttttaatttattttaattttcttttttttttttttttttttttagagatagggtcttgctttcttgcccaggttgctgtgcagtggcatgatcatagctcacagcagcctcgaactcctgagctcaagcaatccttctgcttcataagtcactgcatccagccttgcccacaaatttctaattttacctcttcttctttatatcttctgagaagaaagagatgtttcctctatcagtggtcatttatagcctttctaagtctaaggaagaattgtggcagacataaagatcgttgaatcaggactaagaaaagtagattctagctgatcttgaaagactgacttcacttctctggggagatgatgggtttggatgaaataattccagaagactttcccatttttactcatctctgactctattacagcttttctatttcacccttgttcccaactctcatcaggaacttaaaagaaagacacaaactcacaaacagcgagaaagagagacagagaaaacaataatgtagggtatcagtcatctattggcacaataatgctgcataacagaccatcctgaaactcagtggcttacaataaggttttgtttttttaattcacgtgtgctggagcagacctgccttaggctgtaggtcacccaaccttggctccaggctaagatcctgaaagaagggctcaaatccactccctgtgtcttaatctaagcccttagataaaggggccacctcctgggacacaccctcctcctggcaaacaatacaaacataggtcctggccaaacacccaagcacacttaaaccttcttctcgtgtccaatctgctgacattccattggccaaagcaagtctcgtgatcaaactccaaatcaatgaggaatgagagtgtgttctgtccacgggtaggagggatttggaaaagccatagatatttgcagaacaataatccaattttccacattctgctacaaatatcatacactgaaatgccttcagaaactgacaggaatgaagcaaacagcagagggaacacaccatcaaaatcaggcagcagggactcagcctcagggtcaaatgtctcttcttcttgtgtttgtttttttcttttgagacaaggtctccctctgttacccaggctggtgtacagtggcacaatcatagctcactgtagcctttacttcctgggctcaagtgatcctcccacctcagcctccaaggtagctgggactataggcacacaccaccacacctggctaattattattattattttttttttgtaaagatgggattttgccatgtagttcaggctggtctcaaattcctgggctcaagtgaacctcccaccttggccttccaaagtgctacgattatggatgtgaaccatcacgccctgccagatgtttgatttttaaagaggggagatagaaagtcacagtcttttgtctaaattttctatttaaaaaaaaaaagttagaaagcagcttactttctgtctgtctgtatacatatggaaaattacatgtatgcatatgtatgtatgtgtatgtagatgtatgtatgcatgtatgtaatatatatgtctgggtaaaacaaagcatctgcagaccagatgtaattttgagattgttatttgcaagctttgactagaaacctctcttgtttaccaatatatgaccctataattacacatctaagatagttttaaaatctttctgggccaggcacggtggctcatgcctgtaatcccagcactttgggaggccgaggtgggcggatcaaaaggtcgggagatcaagaccatccttggctaacacggtgaaaccccatctctactaaaaatacaaacaattagccgggcgtagtggcgggcacctgtagtcccagctactcaggaggctgaggcaggagaatggcatgaacccgggaggcagagcttgcagtgagccgagatcgcgccactgcactccagcctgagcgacaaagtgagactcggtctcaaaaaaaaaaaaaaaaaatatatatatatatatatatatatatatttcttttgtattcaatgaggccataatttcatcctgccccatgcagagttaacacgtggtcaagctctttggcctaaccttgtgtagatctttcctaaaaactaaggactgtgtacctatgatgttacaatgttgcattactagagaaacacaggatttactcagcactttcaagtacatacattgacttaatccacatagtaagtgattctattagcattttgtagatgagaaaactggggctcagaaaaattacatgaaattttcaaggtcgtagggctatagcagagctaggtttctaggtcatttaactctttctcaactggcaaggaagctaagtaatcacagattcacagaacaccaaaagctgttctggctactgttatgatttgattctaatattaattatgtggttagaatgattgtattagtctgttttcacactgctataaagaaatatgccagactcaggaaagaggcttaatagttcctcatggttagggaagcctcaggaaacccacaatcatggcagaagacgaaggggaagcaaggaccttcttcacatggtggcaagagagagaagaaagaaggaggagcttctaaacatttgtaaaaccatcaaatattgggtgcaccaaaatctcagaaatcgccactcaagaacttactcatataatcaaatactacctgtttcccaaaaatctattgcagtacaaaataaatttataaaaagaaattaagcattgaaaacagatatttctttcctggaaaaaaaaatcagatcttgtgagaactcactatgacgaggagagcacatcacctccctcttaacacgtggtaattacaatttgagataagatttgggtggggatacagagacagaccatatcagtggtatttcaaaatatcttccttttgagtcatttaaatcccttatttgatgcagagatagtaaaagccctaccagataatcaggaggttgctattatccttttttgtactttgtttcatctgctcttatgtctttgaacctcatttccgtcagatgattaaataatgattatcttgtctacaaataattggttttgttttgtgatttcacttgacctcaagtgacatgatacagttttaagaatgtcacagatgttaagttgtaaatcagggagtgctattttttttaatcagagaaatatgatgattcagtgtttagaacatattctttaaaatgaggggacagagattctaaacttgattctgctgcaaatcagctatgtcatttggggctctgacatctcattttactctctgaatcatctaggaaaaagtaagatgatgattacaaagcactgggagctctttcaaaaggcacagctttcatctaaaatgatattactaattaattaatcagatcaattccctgttaactcatcctaatagcccaagccctgttagccaagtatattactgtgatttattttgacacttaatggaaccgtgcagcatttcagtcacaggttgataacctaagcattataaacttcaagcagtgtttatagttttgttgttgttgtttttcctgaagacagctgataaaagatacccttttaggaggtgctagctacatccctcaaatgataaaaaatacaaagtggtgagtagatgttatgaacagcattgtccttaaaagagaagtcaccactgatctcgaagaaaagtttgcaaaataaggaagaagaagatgaggagatgcagtcttcatttcatttcttttcccaatattttgctgctgttttgtttttaatatcttccttggagcaatgaatcaaatgtcttccatcaaagaaaagcaatattgatatacatttgcacatagtaaaatctgcatgaattcacggctcctggaaaggaaaatattttctctctttctctcttcctgtgtttctttaatgtaataaaatagcttcccttggaggtcaaaggattctgccatttctcttttctgtgctctaagacagttgcaaccacttgttttgaaacttgcttttggttttggggagttttaatggaggtattaactggtgcctaaagggagcaggttatgtatatgtaaaagcagggaagttataggaaagtagctataaagactctaagcagttcaagagagttatgttaattgctgtttcaaaatgctcccctgtagtgggagccttaggcctccagaactcacttttctctcagtgactcttatttagtttattttcctttttatactgtgctttttagagttttcctggtctcttttactttgaaatctcaaaggctgtccctcggaggatccactgtttacttctgaacactttctagagattctgatgggtccaaattccccaaggagctggtaaaggtctgcttcctcccttcatgctgagtgtgaaagaagggaagagtctttcacttcaaacttcagagaggtctacctaactggagagtgaaccgaaactctgaggagcactggccagggagggggagggcagcacactgcactgtctcacctgggcattttcattgtcacccactatgaaagatctgctaggagaatcgagtttcagagaaaaaaaggaatgaacatattttgcatgacagcagtagtatttcccctctgttccccttctacagagaaaaaaaaaatgtgttaatgactttctaagaacaattactatataaatgtgacaaatttagattgaatttggatttgatcctcttctcacacccatttaaattggtttgtgctcctagctcctgtgccatatcctatgtggaaatttaagaatgacaaagttcataaatttggaaaggagaagtttgtttctcataaagggttgcagcttgcagggtggccattctgacgggctgagaagtgtagcctccagtcagaagccagaaacagacactttgagggaggggcaaagggaacaggaatttatgctgagctagtgactgaatatacatatttaataagctgtaggaggagtcatgaatatttgtgatagaagaaacatgcacagatccagcggagctttatgccccttcctgagtctcactacaaaaaaatggcagtacaagcatgatctgagggtggcgttttccatgctctaacatcaataggtgaagccaaggtcgcaaaaactcttactgcacattctccatagactggacagaaccattccatggtcagtgttctcttatcagccaaaaaaggaagggcagcctcaggcagatcagtagtgtggtcttttgaaagaactggtttctgtttagcccttagggaataaagcctaattgtgattagcaagggagggggtataacaaggcatgtctgacctcccatttcattatggccaataaagcagttttcaagcttattttggggtccctttggccaagagatgatctgttcggtcaggtgggggacttagaattttattttccgtttacatatggaatagccaaatattttatgatacactttgctagattgtgaaatgtttggcaaatgaaagaatgggacattttcggggcgaggggaaggtcagcgaattcatctcaggatatcctgaagaaatcaaataatgaggcagacaagaccacccttgaacagactgccatatttcttgagcttcaggaagtttctttggaatgccaaagtaagaataaagttggcctcccatgaatactagggcaatttggtgatgcttactcagatccaaagaaataaattataacaaaactggaaaagtacccatgaatcagggccaaatttataagcatacacctaaaagtatggaattccaggcctgatatgtgaaacgtaaagccctaaggcaaatatatttcatgtgggttggcataaggttgcttccattttcacagtattttaaaaaacaaaatgaagtttttggcaatgcttcacaattgtagttttcacttaaaaatacagatttctggcttctcttggaagactaggacacacatgcccaagaattgaatagcagctacttctttcggcagtaacatgaactcacctggtccatgtgttcatgtcttacccaccatcccctcacacacatactcccaagtatctgactcttgacacttcccttactcccttgacctgctgtacctctgttgctgttctatttatcaagcaggaccctgtcctctcccaaaatattctccagagtgatggactgtgttttctgggaggcttctctcacctgaaggacaaggttgacctgtctggctgcctttgctggctgatgctgactatttccaactcagctctctgctccatttggtgctggcttcttccagttgtggatcctagtctgtcatcttgacgacactccagaccacccaaaatgtcaacttggcagttgtttaaatcaaatcatataataaaataattaagctgttaggctgtgctgatatacattgatactcttagtacacacacctgcaagagtggtctctttgtaaactacatgacaacgagaacattcccttttaaaagttcctattttcaaatctgcctaacagcaacatatttgctccaaaactacatttctattttacaggagagagaacagaaaccaaagcaaaactaaatttcatgtcttgattactcaacaagagagtgtattgatgacacaagttgtcctgggttaggtagtgattatatttaagtgccatagaagattttcttggaagagattgcaatcactataagtacttagcattgcattgcttacatgaaaagaatgcgactgttgagaggaaaagaagcctctttagtatagattagtcttcctattgtccattaattatgaatgaaagttgaaattcggctcattgtgattcaatgctagattctataaaaacaacagtgcttgtttaaggaactgcctggaagatctgctttgctcttttgctggtgcagttacttgtggaggttataggaatttagggacatggatttttcctgttactacagcataaatatgttgtaatatacaaatatacatgtatatctgaatatgtatgctgtatatatttacacacacatacatattctaaaactcttctacttcaaccagggcagcagctactcttctgtttagttttatataatgaggttccatataagattatacttaaagagaaagtgccggtttggttaagtaaaatttagaaaaatactaatctagtccaactgtcctattttctgcatgaagagaccactgagagacatgttttttttttttcatcacactgttggttagtgacagagccaagttgattcttttttttccttccttccttctttccttccttccttccttccttccttccttccttccttccttccttccttccttccttccttccttctttccttccttccttccttccttccctccctccctctctccctccctccctccttccttcctctctctctctctctctttctttcgagacagagtctcactctgttgcccagactggagtgcagtggcacgatcttggcttactgcaacctctgcctcccaggttcaagcaattctcctgcctcagcctcccgagtagctgggattacaggcatgagccatcacacatggctaatttttgtatttttagtagagacagggcttcaccatgctggccaggctggttctggttttgaactcctggtcttgagagatctgcctgcctcggcctcccaaagtgctgggattataggcgtgagccactgcaccccaccagagccaggtttagaatacaacgctcccaactcctagtcagtgttctttgtactgtatttggccaatatgtattgattgtttgctatgcacagacactgtgccaagattgaatttcctcaggtgataatcccactaaccccatgaggtcaatcttacgtatgttagagaaaaggataaaaaccctcagggaagataagtaacttggtcaagtttgcacagctacaaagtgcagtgtcaaaaattcaagtctaatttaatctaattccaatgtcaataactgtactcttatccacttctctctactttcctcataaccatttttttcccaggttggtagaatagaccacaaaagccaactttgtgtgcatttctatatccatatataaaataatataccaaaatacatttgatcatggcatatttattaagtgttctatattactctgagctctattactctttaaaattttttaaattctattcataagcgacacataataattgtacatctttctgaacttcattcttaaaggaacaattgtagctgcatcgaagttgacatcagggcaatttctgcttcacagattttgagggcctggaagaagatttgatgagaatattttaatccctggatgaattttatttacctgtgtaggcaaaaacttagtaaaagatctttgaaccctaaatattttactttaggtacagaggttataaaatacctctgtacctttaggtacagaggttgaaatgaatgaactgttatcttagatagtatgccatttcagcatgagaagggaatctgaggatttattatctataaacacagaatattcttgcagaatatcttcaacaagcacttccagtcataattgaaggaactgaccagcaaagagagaagggaaagaaaagtgatttatagctcatatgctgtcttgataaaggatctaggttttatgaaatattatggaaactttaagtgctgagaattctatgcaatctaatcaaagattgtagtgctgtgagtaaaagaaaaaaatgtaacaacagagagggattggagaggagtggaagaaacagcaagtaggaatcacacagagactaacaatgataattcacaatgataattcaatttaagctggtcctctaactatcatatcccatggggatcccaggagttacctggagactcggcattattattcagagaacacttggaattaatgcctctcttattgttgaaattctccctagagttgtttgcatacaccttgatatcgatgttctaagaagctattatccctttatgtgcattagatcacagaacagctacattagagatgctcttgaattttgatttaatcaaacaggcatttttatgcttcagtcctaataatggttccagtggttcatccagtagttcctgatatttgggtaaagaggtaggcaatgtgagctgtccattgagatattttgctttgcttaattcagtgtgatgctgtgaaactcaaccaataacagtttgaaagtgtgcccatgtatccaaataccaagtagcagcaggaaaagagttctctgcagccagtaacaattagagatttattaagactctggaaaacttactggctggtcaaaaaaaccaatgataatctccacctcactcagggaatttaaggttgtttgtttgtttctttgtttgtgtgttttcccctccacagcctaaggattcagaaaggtcagaaaaacagaagtcacttctcttgatacttcttcccataaagacttacctttctgccagggaaagatatagatttgtataacttccattattgtagaaaacacaaccaagaacctgccgcaggagatatcctgaaaaccattgcaactgttccacgtggggcgaaaagacatctctagttgtgttggagccttattgatgttttgtattgctatgttctgctgtgccattcttgtatgaaaaacaggaaaaagataagttataaggcattttagcatatcagagcatggttagcacatttagcttagaggagttgctccattacaaaattacctctttgtaaatcatattattaaaaaaaacacacatctgtcttctcagggaattgccttctgaatataaatctttgagaactgatacttaaattccactgtaatttaagtttcactgtaattaaccaacattttatggcctagcccacttctgccttctaatatatagtttagtgggaaagacacaagttaaacaaacagaaaaataaatatttatttaagattctagaaaatcttttaactggacagagaacagccttgccacatgagagaatagactaagaatggcttacattaagtttactagtctggtatgttctctctgagcagatagttaagctgagtcctgaaggatgagacagtaaaaccattgggagaacaaaggaagaagactaggctgtgcagaaattgttgtggtttgaaaaagctgagtggggaacgggaagaggcccaccttgccaaaaaggtatttaaaaacaaggaagaagagggcaatgacatgcagtggtaggcaaggctttatcacgtaagactttaagaatattgtagctctagtgaaagtttgaatcagagaaatttaaatacctaaatgtcactttgaaagatcattctaactattgtttgatgaatggtggttgctatagggcaaggggcaaaatggaagttcattgggaggcttctgtagttgtttacaaagtaaacaatgatggcttagactagggtggtatccatagagagagaagtagacagattcaagatgcatttttgagggaaaactgagagttgtatgaattcagtgtgagggattcaggactatgtgacatctcatgaatgccctcctggtttctgctctgagtgtgtgggtagatggtgacattatttactgagatgacgagggcatcatctataccttgaatacattgaatgtatttcttaatttctccctcattcctccttctccctttccttaccatgtttctctaaatcctagctatcttttcagattcagcatgcttaataaacatattgagtaataattaaaataataagtttaaaatttttgagtggttctaaacactgtacatgcccaatttatttaatcctcccaataaaactctataggagaaattctctttacaaataaagaatgtggagacacagagagcatacataatatgcctaaggtcacacagctgtatagcaattgctaggaaaagcaagcatttacctttacagagttacagtcaaatgcaggtggcagacttacaaacagactgatgcaatgctttggcaaagctgttttaacaatggtttcagtggccttctatgtgacccatgcaggggaaactgatctggccctgggcaaatgtctgtgctgttataacaaaataccacagactgggtaatttataaagactagaaatttatttcttatagttctgaggctgggaagtccaagatcaagatgctagcaggctcagtttctgatgagggctatctctgctttcaagatggcttcttcttgctgcatctctggaggggaagaacactgtgtccccacatggtggaaggtggaagtgcccttcaaatactgtctgaagtctctttaatgggggcctcaatcccatttatgaggagaggaggcctcatgacctaatcatcttaatatgtacacattggctagtaattttcaacgtctgaattttagagaggacacagtcaaatcatagcagcagagataatgaagacaggctttctagaggggatgatacccgagctacactttgaaaagaaggtaaaaatcctggtggaattaatgggggcagggaaggctttctcaggtaaaggaacatatatgcaaaggacactatgtagtggggtaagagcagggagaaataatgagatagtattgagggacaattgatgggaaatatggctaaagagatagattacagagatgaagtctggtattcatagagatgtactttaattatttaaaatagatctcttggcactatatcgagtcgatgaattggggagggcttaagtcacaagtctagaaatacaatttgaaaacttgcatttttatttttctattggagaaaaatgatggtttgatacagagcaacggtgttagagatgaagaaaagatgaatttgaagattaaatgagacaggacatagaaagcactcagcacaaagtttggcatagattacctacataagaaatatcattgtttcagatgtctgttgctgtttaacaatccattgtaaagcttggttgcttaaaacaacaaatacttactattttcttctaattctgtgagttgagtgggctcttctgggtggttcttctagtcttcagttgcaagtaaatttgatttaattgattatgactgaggtcactcatgtagctacattcaatttcaactggactggggctggagctgcaagaatggcctttctccaaggcctcttttcagacaagctttagtcattcactggtctagcctggacaacatggcagctgggttctaagagagagacagtggaagctgctaatgctcttactgtatggtcccaaaagccctataaccattttcctttcaccttcaaattggtcaaatcagttacaaggccaacccaaatccaaggagaggggaaatagagggagacatatgcagatagagaaatggcaaaaaaaaaaaaaaaaaaaaaagttgttggtgactgtatttgtagactgcataccagttatttaaattgtctaatgccaatttaattccttaaacagcattcttcatttatatttgtattagtttctttctctagctctataagcttcctttctatctcacacagagtctttcctatcttgtactaaatctatgttttagggtttttttccccttaatgtcccggagaatacaaaacagcagttaccggaaattcaatttattttcctagctgaggtaaatatttttcaaaattatagtctttatttatcttttacattctttcttttttaaattttcttttttagttgctgaatattttcaaacatactggttatgcatatgtatgcctgtatgtggcttgtttatttttcttgactgactattgaggatgacaagtctatacagtctatccatgttttctatttgcataaaaattgtttgtctcgattctccttgagacctgggcagcttgagttctccccatttatatgggcatctttaactcttgaggattgtgtgctggaggtttctaattagcaaagtggaaaggcagctacagtcctagttgataaatactttacgtcatggtttttgtcttgtttgttttgcaaagaatgtatcagactgctgtgttcacctgaccttatttctagatacaccatgtggttctcatcactatcactctggagtttctacctatcactctggggagtctccagtcctattggaggggtatttgtctcattaattaaaaggctcctcctggtttagtcacctatattgattaaaagtcatgaaaattccactatctttctctttaatgatgccttaggtaaggatacagcttactatccaaaataggacacttttaggataaagatacattgttaataatgtataataataaataagacaaaaaatgtaactattttggaaaatgaggctatatggtcactcaagtgatgccataactggagcttttgcaaccagtgtgtctccagttgcctctctttccccgtagccagacctccatccatgtcctccagactggtggagtttaccccagtgggagcaagtttacactgatattagtagaaactgtgcttggaaaaaaatacacttaaaatagactcatgctttctcttcccacttcacacggatgctgacccacgatgaggaaagggatgcgagctggctacctatgtctcagttccctcttccttcaaaaggtgcaaatattaaatagtttgcacttcttcccctcaacatttcttgcgatattccttgaaagaaaagttagttgttagtggatattccatgtaatagtctcaaatgtcgaatctgtggtagagagcaaagcatataaaaaaattataggggattaagtgtgtgactctacagtttgaaaaaagcactgtagctagttttaacatgcagtatctctgacttccccagcgcatgtgtattgagaaccactatcctctctgatgtaacagtaaggtgtgttgtaacaagtgcctggtagctcatgctaccaggatcaagaaaaattagctctgaggaatgatttttttctacttttattttatatggtattaatcacatctaagtaaacttgctttttgtttgaagccagatgccccaacagaccaagttacacagaaaagaaatttatgcatctggtcattaatgcatatttggcccctaatagctacatgtaaaataattcacttgaaaacattactcatttttgtcaaagggctgcacaagagctttattatacatcttatttttaaactgacttctactataaatgaagttttactacttcctgatcatcttcttctgacaacttgctattcagtttttttggcaaaataaaataacaataaaacgtgattaatttattgatgaatggatggagaaatagatgagtggatagacatatgattaaaacaagaacagtaaagctttagtggtagaatctagatggtggataaatggggggccatggtagatttctttcaacttttctgaattttgaaaatttacataataaaatgttggaaaatgattacttattattttctattaaaaatcacggagtaggccgggtgcggtggctcatgcctgtaatcccagcactttgggaggccaagatgggcagatcaccaggtcaggagatcgagaccatcctggctaacacagtgaaaccacgtctctactaaaaatacaaaaaaaaaattagccgggcatggtggcgggcgcctgtagtcccagctactcgggaggctgaggcaggagaatggcgtgaacccgggaggcggagcttgcggtgagccgagttggcgccgctgcactccagcctgggtgacagagcgagactccgtctcaaaaaaaaaaaaaaaaaaaattaaaaaaaatcatggagtaaagggaagttttgtagtgctgtcctctctctaactgaacaagagccactaaaagcagttagaacacaagttccaagcaaaacaaaacaaaacaaaaaaacacagcagtggctctgaagctctccctcctgtcagagatcgtgcagtccagatggattcatgggaactgagaactgactcctgccgtcttgattctcttggagaatatagattccctctcccccaacaacaagtgtcgtgatcctgaaagacgtatctaagaattctttacatcgagttgtaaaacctcaggtcatttaagtgactcagtaggggagaaaaaacataaggcaaacagaaaaagagggtaagtttagggaggaattatgcagcagagttattttctatgttctgtaagtagatctttaaggggaggagtgttctctgaggtgaaggggtgtcaaggagtgtcagattgaagcagagagccctaactgaaaggcttttagctgagtttccctgaggcaggtcctcaggtgtccaacattcctgagcagccactgtgcatgtttcatcatacatatcccaccgtgctttctcttcatcccgatactcttctgcacaaaatagccaccctaactttaaaaatcaataatacttttggaccagttgaaaaaataagagaaattaaaagaataaaagcaaaattaagggatattaatataaagcagatggacatcatatatcacagaaataatacccaaagagacacaggaatattttataaaatacttcttcatatccgcagagttctggttaacatgttttatcaaaaacaagcgatcgaagaatagatacaagggttcaaataaaaagtaatggcataacataaaagcgttagagttaagccccgttaaaaataacaaaaggagaataagatggactaaaattaaagactaaggagatgaatttgagaaaatcttaacaatattaaaaaaaaaaaacccagcaggggcaaatcattctagattagatgacagctattatagacagtcaaaagatatccagtgtattaataatttatgttgctcagaacaagtggaagagaaaaaattatatttaagatagaatgagaaaacatgagttgagaaacatgatcctaatttgtaagaaaaaaaagtgtgtgccagaaaaaattgatgaaaattttcaatagcaaggcattataatattgaagttactgaactgcaaggataaagaaaaaaatatcacatttctatgtaagcagaaaaagtaaattaaatgtgatgcttgatgtattatagtatctgatgccagaagatagttggctattgtctacaaagttaaaaggaagaaaattataacagaataagataatactcctcctttttcttttgaatagaaagtcaaataacaaattatctcacatatgcaagaactgagggacgagagtagacttgccccatttttggtgtgaagggcaggtggacacaaggctgtgaagttcagccaaccaagagatctggactcttgaaaatgaagggataaagaaggtaaagaaacagtgtcactcaatacatatatttaaatttagaaagcagataaaacaacaatggggattatagttataaatagaatacaaacattttaaaccttgacaatacaaaataatcatataactatcaaaattaagtgattgagatggcatacaaagtgtaagtgtcccaatttttgtatcccatactgtaggaataaagaaaatttttgttttgttttgtttttgtttttgtgtttgtttttgagacagagtctcactctgtcgcccaggctggaatgcagtggtgtgatctcggctcactgcaacctctgcctcctggttcaaacgattctcctgcctcagcctctcgagtagttgtgactacaggcatgcgccaccaagcctggctcatttttgtatttttaatagagacgggatttcaccatgctggccaagctggtctcgaactcctggcctcaagtgatctgcctgcctcggcctcccaaagtgctgggattacaggccgaagaaacattttctactgttggcatacatagttttatgtatatacttatttattttttatttcaacttgtattttagattcaggggtacatgtataggtctgttacatgggcatattctgtgatgctgaggtttggggtacaatgaatcccatcactcaaatagtgaacatagtacccaatctgtagtttttcaactcttgcttctctccctccatcccccagtaggagtcccccgtggctgttgttcctatctttatgtccatgtgtacccaatgtttagctcccacttgtaagtgagaacatgcagtatttggttttctgtgttaatttgcttagggtaatggcctccagctgcatccatgttgctacaaaggaatgattttgatatttttttatggttgggcagtgaaatacatagtttgcccatattgactccaacttttaaaatgctttaaaaatcttcttttttaaaaaatttaaagaaatattttagaaaataaaatttttgtgctatggaaatgttatgtaaaatctttcaatttaacttttttatcacttgaattcaagtttaatcttctctcctgtgaataagcctactgctgtatgaaatgctgtttaccaaaggatgacaatgattatttctgaatttgggggaattgcaatgttttttattttacttttctgtattgattttttaagtctatatcactttttcaagaaatatactctttttaatgtaatcgtttccatctggtgttaacaaaggcaaagaatgactttgaggataattctttaatctttccatatccacaggcagctcatttgagcacgagtagttagttgctttgactggatagtgatctctgttagccatgaaggtggtaaagtcactggaatcatcgattccatttagattccagtagcttagacaaaaagcgaccagtttactaaaaaccttagaaaacaccttagaaaacacctggaaatgccacacttaactgccgttgctgagattattagagttttgctgctgttgttgtgggtatactttaagggtaactaaatttccagagccataagtatatgaagccttgtccttcgtaatagtggaactgaagttcttaagaggggctcaggaggctgactcattgtttcctcttaggaagtattggtatttaacatgtgatttaaaatatctataaattgagttatgacatgagttttcacatgatgaccttctcaccaatgtatttgtgtaattttgatgttagtggagttagtttatgtagtgaaggtggaaaaatgtgttactaagaggtaattactgtaaagctatttaattattgatttccccaacatagcaggattgacattttgcagatatagtgaaggaaaagatatgcattaacagaatgagaacagaataaatgtacgttttaaaaagaaacacaattcattttaataggtatgcagtcattattcaggaaatgtgactgcttctccataaatgacattagctgtttaagttaaaatgacagacctataataagtaaagatattatgagggcgttttaaaccctagcattggcgtaaggttatattaaaacttcatatttaccaacattgtttttttgtagtctctgtcttcattaccctttatgaaaagcacactttattttgaagtatttatattggcttgtgcttcattcttcacttagaaaagcattttgctttgcatatttgtctaatagctataaataaatgcagctacttcttcccttgaaatgagcaactttgcattttaggctgaatgaaaaagatcagctcaggacttctacagaagttccagccttgctgaatccttgctttttcatccctggtttatctgcctttctgatttctagccacagcgaacaagcatctgactacatggtaatgagcccttaaaatgacaaaaagaagtgcttacacattcaaaggagttttagcttctaaagaatagcctttggttgaaagcatgttttgaactgtcttttggattgcgttcagagtcagtgtatgagacccacaagaaacaatgcctcatttaattacggcggcacatgattcctaacataaaatcatatgacccagctggtcaacattcatatcaggcaagctttgtttgaaataatattcagccatttttcttatatgacagcaaaaacacaaagggaaggatttgtcaccatttaaataattcaaagaatgtaacagcgattctaaaatgagttcccaaaaatgaagtttcagaaatattctgggccataaaagactattgagtatctaagaaaaagttggaaatagaaaagcttaaaaaatgaaatctgcagaatgaaaaggaggtggcaaatataaaaataatgaattgaaaagtgaaaaaatattttcaaattgattaataactttaagtactttttggaaacactacataaagaaggaagaaaacacaagtgcataaaatttaaaatggcataaaggaaatgagagttatattagaaattaaaagaataataaaatagtgcttcataaagctctacaaaaatgcatgttaacaattctcaaaatttgaggaaccaagtgttaacaaaagtgattctacagaagagatgaaactcgttgatgaataactatgaaaattatatagaaaattattaaaaaggtatagcaaaaagaaatttccagactcaaatggttttcaaagggagaattcttctgaaattttaaagaaccaatttactaattacttaagctttccaaaacagagaagtaatgcagcctccaaattttttatacaaagacaatgtaacatctaagttgaaatttgatagagatgatgaaataggacaaacttataacagtcttatgtaatataatcgtactactgttggggccaaaacattaaatgttagccaaatgaatggtggtatattgaaataattgtgtgtcattaatcaagaatatgtatttttcaaataaatattcagcatcaagttaaatgataaaaattttgaatttttacattcttattatgaataagatagtaatgcctactatccccgccattaaaattattctagaaatagcacatgtaattcaatatgagaaatgagaattaaaggtataggtattggtaaggaagagacaaaaattattgttagttctattcctaagggactttatctcaggtatccctctctgacaacataattgagaagagaaatgagcaagagtcagattatccaggaggccgtgtctagggttcttatgtgatttatgtctctgatttatgtaaatattgacaaatatagattaatctctagatggtagaaaaaccaaaggaggagcccctgctcacagagaaaataaaagatgaattcaatgtttcttagatccagcttaatctaaaccatggggcattaaatctttttagaaaaaaaattatcattagttgctgcttatgtaattgtatacctagtaaatgcagtggaatcaactgagaaatgtgcaaaataattagttaatatagaaaagtaccaggaacaaaatcattagctttgattcttcatcttttctatttggtcagtttaattatatacagaaaatagatgtcaatgtatttggatgagttttataaagtattatgttatcattaatttcattttctctatatctgttattaccctgttatgattttaactgttgtgtacatgtctttgtgttctgcctttttcatttttattatgcttcatttttcaaaaggtctaaaactcactgatcaattctactattatttttctttgttttccatctttcctgtcaccttccttttgatttccatggaagtagttagtcattcttctcaattctttatttggatgctcaatgttctctccattggcaaggccacttctggaacttgatatttggagatttctttgaagttaacattcttttctttggaatattttaaatggtcacaaatactcttctatttattttcattgggtaatacaaaaaagtagttaagtttatctaaagaaagcttagctgatatacactggttgaccaaggtaggccatgtcaatctgtataaaaaaaaccatgtgtcactatgaagtaaatgagacattgtctcttgtgggcaattttaaaaaaaaaaggatgttcaaaatatgtttttaataaagtctgattatgtttcttttcagtagctaacattcatttagatgtgtaagcatcatttggggggatgtataatttttaagaattcattacaagtatcacaaaagataaacacacataaagaattatataaaaattagtagcattgtaaacaacccaaagcagttagaaaatacaatgggagaaataatccatttataatagcaacaagaaaagtaaaatgcctggtattaaagttaaccagaaatgtgaaggacccatatgaagaaaacttgaagctctaaagataacataaaagaattcttagtaaaattagagatacaggtattctttataggaaaccacaatattatacattgacaaactgacaaatctcagtttagtaagctgcaaattcaatgtcttaacactccatccaaatttatttttgtacttgacaaaataacacaaagttcatcatgaaaaataaaagtgaaaaatgctttgaaatgtttcgaaaaggaaaatgaatgagctggaaatagtattatctatataaaaatagccaacaaggctgtactagcttaatcagcttgacactagagaaccaatagattgtgagagaatgttcccagattctccagattcagaggtaatactggcattcaaatcattgggaaaagagctttttcactaggtggtgccgggacaaggtactaactgcatgcaaaaacaaaaattggatggtagtctcatttctcttaccaaagtaaattacagaaagtaaaaattaaactatgacagtttgaggaaaaacatgagtgaatttatttaaaattttggaattagtggaaagtctttccatgaaggacacaagacacagagcacaaaagagaaaacattaacaaatctataaagttacaaccaactaaaaaaaaatctgaactaataaaaatacagtctaaacatgtgacaggtcgagactaattttcttaatttgcaaaattttatacaaattagtaaggaaaaaatacacttaacccaagggaaaatggacaagttgctgaaaaagaaatacaaatggacaataaaaacgtaagaggaccatctttgccttcctaattaaagaaaggcgaataaacaataatgagatgtcatgttttaatcaatcagattgatagcagttaaaaaaagttagataatatccagtgtcaaatgaggatccagaaaaatagccactgttaatacattgttgcttgaggtgtaaattggctcgacctctttgtcagacatttaggtcatatgcgcagaagtctggaatatacatttcttcatgactttgtgatgcctctgatgggaatttattcaatagtatattcacacatgttttctaagatgtactagcaagaatgcttactgtaaaacatacaaactgaaaatactagaaatgatcacataacggacctggctgaaccattaaggtatatggcacaactgctgaaaggctaaataatcttaaaacatgaagcgtatctcttaatcttaaaacatgaagcgtatctctaagtgcagatatgaaaacacctacaagataaatgacgtcatttaaaaattaaagtgacgatcactgtgtataatgtggttcattttgtataaaaaaagactgtgtgtgtgtgtgcatgcgcatgtgtgtgattaaaatatatctggaaagaggtgagatattgaactccgattgcctttgtgtagaatacttgttctcagatttcagtgtgcatcacaatcaccaggaaggtttgttaaaacccaggtccccaccgtagagactctgattcagtgaatctggggtgaagcctaagaatttgtatttctaacagtttcccaggtgatactgctgcctctgttccaggcaccacactatgtagaccctctatggagaggaactaggcttttcacttgatatcttcctgttcatttaatttttagaaatagtatatgtatttcttttgtttttcctttaagatcaaaagcagcaatctgaattgtaagattctggggcattttaattttttctttatacttaatcacattttaaaaagccatactgttaaaaaaaattctaccaaataagatcaaatccactgctttttagttgctccttaaatattttgtttggtaattcatttccttaagaatagacttagtgaaatattaaatttttcttatatgtattcctcctaggtagatccttgtatcataatttgaactcagaagttagattggcttgtgtggtatgccaagaaataaaaatattttaagaatattggggatttacattattttatattatatataatatatatcataacatctatattatataaataaatatataattttattatattatattaagaatggggatttacattattttatataatatataatataaaaattagtggcaaatataaaagataataaaagatattttatatataatatatttaaaagaatgaaagaaccgtcaccattttctgtaaaataagaatgacaatatgcagcatgcaacagctatcatagagaaccacttaagatgacagacaacatggcaaatccttaaggaagactcctggcattgggatatgctgtcttatttgtatttctgttaatacagctttatgattgcattgcatttctgggtttgaactttgtaaagatttagagcaataacaacaacgacaacaaatggattgtccaattctatccactcctttttttcttttagcaagtcatattcctgtaatcttctcttgctattatttttcttttgttaagatttatattattttttatttattcagcgttcattatatagtctcccttaggagcactgaataacacatacaaacaaatatgaaatagctaaaaatttgaatccctgtcttgccaaccctcatatcttcagctggggcagaaaacctgagcaaacaggcattgcactagaccgtgtcggcagcaaagcaagctgtagtcaggttcccaagggaatgaattcttatgttttgttttccataccaagaccattttttctcctttcccctaaagatcaaatctggtggttcattagctattctggctgatctcagcttcctctgtgcatgctcttgtcttcccatccccacaactccaggggtttgatagaacaaggttaatactcggaatcacggtcaggagcaaattgattgcaagtggaggatgtaaagcttgtctgtcaccatctccttatggcctcaagttaagcaggcggtttgcatcaagtgaagctttaaaagtctcttttttaactgacatccgtaacagagaacgctatttctctcaaaccatatgccactaacgcctgattagctatgatcagatagaccgatagatacactattaaaaagaattgaaccccgtggctagttcctatgaatgttgaataagtaattaatgtcttcctctttcctaccccccacccaaccagtctgctgttatttaatttaacaagcatttgacggagcatatcttgtatgctaggtaggtactaagaaaagatctccttgtctgcacaattccaaaagttgccatttatatggattttaatgtgaatagtgcccccagggagttgtgcaattgcaaccttcctagccattcatgtcactaagctaggccaaaggagggggaattgttgtgacgagttataagacatcatttgtgccttgtcagagttcacataggagaacggttagtggggaaagaggtacagccacaggttactataagtcataaatcaagatacatttatgtttctatagatatctgactaaaggggtgtgggatcagcaatgagggtgtagtaaattctgcttgggatggggtgcaggaatcaagaaaggcatcaaagagaagacgacatttgatttgggcgtttgagaatgcgtcacactcagagccaaggggagtgggagggtaggccatggtgtagttggaaataacaagaatgccactgttgcccgccattgtctggagtgaatgccagccgggaatcatttaaacactttctcttgtaatttgaaggacacaaaccatggcttctctctcagtgaaagaccattattctctaaattgtttaatctgtagtcccgatttattaagatatgtgtggcttgtcttgggagtctgagtaatcactgacattgtataggggaatacatttgcatggcattataagaatgtcaagttgtctttcaaaactgagtatagataaaaggctcaccaatgcctgggccatctctgagtgccgactgtgggaacatccgttggtggcattcgttctactgtatgcacacatttcaatcagcccaaaaggcctcctgtccacagaaggctggacagtccttacctctcactcataatgccacattagcatttctattctcatgctctgtggtcataagaggctgggagatcttcggagagacatttctcaacctgtagacacaaaaggggtgctttgagctctttgaagggcagcatttcagtgggggtgcatctgttaaaagactgtgttgcaccccaacacctctggagactgaaagggaagcaatttgggatagcagaaatggacgcaggtattaatggaaggagattgtaataaggaatgtaaagaaatggaatacacatacactgccttatctgagccattttccatagtggtgttaactataagaagcccacgttaatactctgaaaatctatccccttcaatccctgcagctatacttcctgctaagacgcaaggcagatggacacattttgaggctcaggccaaaattcattgagctctctaattttaagaattttgaactttcctaccacacacacacaaattttagaagtcttttcctcttgatgtacacatttgtttcaagattgtgcctttcaaaacctttgcacgtaacaaatagttttgagtatgcaattaaataaagaagttatttaatattagctgtgattgaatgtgcaggctctaaaatcagattccctgggttgatatgcacagtatgccaactgaaacagtcacctctcttaatggaccttagtcttcccctctgagaaacagggattatggtcaaaagtataagaggtcatgtcagcagagtgccgggcatttggcaaatgctcaataatacttagaattattatctcctgaaaatttctttggtgtcagatgccatcaaatgtaacttctaaataacatgaaatgagtactggtaacagtgaattgacacgattctagccaaaagcaagcaaacttgacttttcacatagtttatagtatctcttcaaggccaagtttgctttgtgagattcactttttttgaaatgttgagaataacatatatatttgaatgcctgttatatatacgagctaggagtgtgtttgactgcaattaatagtgttctaaataattagcagtatattttcttacgtatcaaggtaggagtttgttgtccttgatttaggtgctcaaaaatgtccttgaggaaccagctgtttctgtcattttcttctagcaacctgaccttttagggttctttttttgtttgtttgtttgtttgttttgtttttgagatggagtctcgctctgttgcccaggctggagtgcagtggcgtgatctcggctcactgcaagctccgcctcccaggttcacgccattctcctgcctcagcctccctagtagctgggactacaggcctccgctaccacgcccggctaatttttttgtattttttagtagagacggggtttcaccgagttagccaggatggtctccatctcctgacctcgtgatccgcccgccccagcctcccaaagtgctgggattacaggcgtgagccaccgcgcccagccttggggttctatctttatgctagtgaccccatggttacaaagtagctgtgatatccaggcctcctaccagcatcacaagccaaaaagagctcaaggctcatcatcggatggtcattttttatcagcaaagtaaaagcttcttagatatatccccagcagagtcttccttatatctcatgggctaaaactgtcatgtagccacgcatagctacaagggaagctggaaaagcaagtaaagaattatcctgagtagactaatcataatctaccaactaagggttgggatgttgcagccttaaaaataatcagggttctattagcatagagcaatggttctcaaacttcagtgagcatcaaaatcacctgaagggcttactaaagcaaaattttgagtcccactgccagaatttctaattcagtaggtctggactagggctcaacaatgtgcatttctaacaagttcccaagtgatagtgatgctgttatctgggatcacactttgagatcttctgtataaagtcacagactttttctgtaaagagtcatatagtaaatatcttatttttggaagttatacattctgcaccagaaatttcagtgcaaaagctgccatagacatttcatgaatgaatgagcatagctgtgttttgctaaaactttatttacaaaaacagatgtgcactggctttggaatagaggatgatagaaattaatactgcatattgtttcagttattgtggtagtatagcaaattattccactttatgttcatgaattcagtgaattatgaaagagcacagtggggatgactcttccctgtcccacaatgtctggggctttaggtgggaagatccaaatgcctgtgattgggtgcttggggactggaatcagctggaagctccttcattcacatgtctggcacctcagctaggatggctaggatacccgctctgccctgactctggatcagaacacctacctgttgcctctctttgggactgagattctcacagcatggtgtctgagttctaagagggaaactgccaagaaaaccagggagaggtttatggtcttcatggacctgccctggaaagtcacgagcatcacttgcatctcattctattggtaaaaagtaagtcacaagcctgctcaaattcaaagggagaattaaacttcaccttgacaaggaaatgacatggtcacattatagaagggtatgtatgatgggagatattttttgtagctacctttggaaaatacattttgccataagcagacacataccaatgtctgttgcctccctcagacagattactgaggctctagatacctcattagaagcctgtgtcccagcatcagagcacagaatgtaggtctatcagagcatgatatgggaggatttctgggtatgaccactaagttttacctggccaatacaactgcttttctatggccccattgcctgtctagtcagccagacagtattgattttttatttcagcaggaccttggctaggttttcggggatagaatgaaaacaaatgaacaaagaaagaaacccggggtatgtatcatccatcatccaacatcattatttagcaaagacctttaatttcttttgtgtgtaagagtaatgccaagaactgccaagttcaaggcaccaactcttctcttcaaagagcttatgatcttttgggaaattgggcctatagttttaaaaaagataaatatcaatgaagaggcatctggtatgtcaaaagaaacactttatattgatatataataattgtacatatttatagggtacctgtgatattgggatacctgcacacaatgtgtaatatccctcacctcaagcgtttatcatttatttgtgttgggaacatttcaaatcttctagctatttttaattaggtaataatttatcattaactagagttattctaatgagctatcaaatgctagaacttattctttctatctaattctctaatatgtttgtacccattaaccaacctcccttcattcctcctcccacccacactttccagcctctgggaaccatcattctatccctcctccataagattaattttttagcttccacatatgagtgaaaacacacagtatttgtctttttgtgtctgggcgatttcacttaaaataatgcctccacctctattcctgtttcttgcaaataacagaatttcattatttttatgacagaacagtattccattgtgtatataaacatattttatttatccattcattcgttaatggacagtaaggttgattccccaccttgactatgttaacagtgcagcaataaacaggtgagtgcaggcatccctttaaaatatttgatttcctttccttttgataagtaatcagtagtgggactgctatatcatatggtagttctgcctctatattgttttgcataatggctatactaatttatatttccaccaatagtttataagagttcccttttctctgcatccttgtcaacacttttttttctttttctttttttcgtctgttcatttgataatagctacgctgattggagtgtagtggtatattattgtggttttgatttgtattgccttgatgactcatgatgttgagcaattttcatatgcctgttggccatttgtatgtcttcttttgagaaatgtccattcagattttggcctgctttttaatggaattctttgtttctttttgctgttgagttgttttgagttctttgtatattctgggtattagcagcttgttgatagtttgcagatattttcttccattctgtaagttatctcttcactttgttgatagtttcctttgctgtgcagaagctttttaatttaatatggtcccatttgcctatttttttgttttttgcctgtgcctatgaagtctgagccacaaagtctttgcctagaccaatgtcctgaagcatttcccctatgttttcttctagtagtttttatagtttcaggttttatatctatatctttaattcattttgagttaatttttgtataagagataaaggtctagttttattcctctgcatagggatattcagttttcccaacaccatatattaaagaggatgtcctttccccaatgtatgttcttaatgcctttgttgaaaatcagttggctgagccaccccgtccgggaggtgaggggcgcctctgcccggccgcccctactgggaagcgaggagcccctctgcccggccaccaccccgtctgggaggtgtactcaacagctcattgagaacaggccatgatgacaatggcggttttgtggaatagaaaggggggaaaggaggggaaaagattgagaaatcggatggttgctgtgtctgtgtagaaagaggtagacatgggagacttttcattttgttctgtactaagaaaaattcttctgccttgggaacctgttgatctgtgaccttacccccaaccctgtgctctctgaaacatgtgctgtgtccactcagggttgaatggattaagggtggtgcaagatgtgctttgttaaacagatgcttgaaggcagcatgctccttaagagtcatcgccactccctaatctcaagtacccagggacacaaacactgcggaagtccgcagggtcctctgcctaggaaaaccagagacctttgttcacttgtttatctgctgaccttccctccactattgtcctgtgaccctgccaaatccccctctgcgagaaacacccaagaatgatcaattaaaaaaaaaaaaaaaaaacgaaaaacaaaacaaacaaacaaaaactggacagtggatggtatcccaggttgaagaaacagcagaaacaaagactgggagggagtaatgtacaagttgtggtctggatagttgggctggagcagaggatgctggaggaggctcagcagggcaggtatgaccgtcacagccactggctggcactagccaatgcagggttcttctgggaactctggggtcctgaaactaaggcagctgaggaacttccagaatgctttaataaattaatatcaaacatgaaaaaaaaaaaagaaaatcagttggctgaaatacatggacttacttctggagtctctattatcttccattaatctacgcatctgtttttataccagtaccatggtgtttgggttactataggtttgtagtatattttgaagtgagattgtatgatgcctccagctttgttctttttgctcagaattgctctggctattcagggtcttttgtggtcctatataaatttaaggcttttggtctatttctgtgaaaaatatcattggcattttgataagcattgcattgaatctctagatagctttgtgtagtgtggacatttttattatatcagttcttctgattcatgaacaggggatgtctttccctttgattgtgcccctttcattttctttcattagtgttttctagtttttattgcagaagtctttaacattcttggttaaatttattcctacatatttccttttattttattggctattataaattgaattgctttcttgatttctttttagctaattcattgttggtgtttagaaatgctactaatttttatattaattttgtatcctgcaactttactgaatttgattgtcggatctcagagtttttcagtgaaatttttaggttagtctgtatataagatcatatcatctgtgggaagggacaaattgacttcctctgttttcaatttggatgacttccatttatttcccttgactgattgctctggctagaaattccaatactatgttgaatcagagtggtgaaagtcatcttcctattgttctagttatttcagctttcagcttttcccccttcagtatgatgccagctgtgggtttgtcatatatagcttttattatgttgagctaccttgctactatgtataacttgttaagagtttttataatgaagggatgttggattttattgaatgctttttctgcatctattgagatgatcatatggtttctgtccttcattctgttgatgtgctgtatcacatttatttgtgtatgttgaactgtccttgcatccctgggataaatatcacttgatcattgtatataaagttttcaaataaacaccctaatgatgtaccttatgtttaatcccttaagatattaaaaaagcaagaacaaaccgaatccaaaattaacagaaaaagaaatagtaaaggtccgagcacaactaactgaaatcatgactgaaaagcaatacattggatcaatgaagtgaaaagtcgtttttttgaaaagataaacaaaataaataaactgctagcaagactaatcaagaaaaaagataatatatccaaataaatcacataagaaatgaaaaatgagacgttacaactgatacaacaaaaatacaaagaatcattagaaattattatgaacaactatacgctaacaaactggaaaacccagaggaaatggatactttcctgaacacctacagtctaccaagattaaagcaggaagaaatagaaaacctgaacaataatgagtaatgagattaaattggtaataaaaggtttcccaataaagaaaagcccaggaccagatggcttattgctgaattctaccaaagttataaagaaaactagcaccaatttttctcaaactattccaaagacttaaagaggagggaattcttcctaactcaccctatgaggctagcatcactctgataccaaaaccaggcaaggacacaataaacaaagaaaaatacaggccaatatccctgacgaaagatgcaaaactccttaataaaacatcagcagagtgaatccaacacatcaaaaagagatacttttgatggctttaaaatgaagctgagattcttctcagctggacagtggaaaaagctaccctagtgtaggattttattaatttgaaccttgaaaggtaaaaagggatggatgaaaagaaagagaaaatatatttcaaataaaaagtgcctgatgatgaaagggtgggacactattggtctcattggagttgaggaggagatcattatgtcagaagaaaaaatgtgtattgagaatgggaaataacattaaaaataatggtggtcactctgttgaaggggctcctacataacatttaataatttagtgatttcccacagtgcaaggcctgggatgctattgtctctactgttctatcttccttctccactagctatttcttacagggacattctgtcatggtgagctcagggcctgcttgtccttctgattacaccagtcataacaaagagtagaccaggcttttccatccaacacactcatcaaagtccattacactgaactttgacatagcaatgcaaatagagacgaaaaacaacaataaaaacaataaaattctagtaaaaagccaaagataaattgctcttaagcacctactctggttattctaaaatgcttcccaatgtttctttaaactataagttcttagaattagggaaaaagcagtttttggtttaaaagattttagactcccaaagaaatgtgtaagcctcattttagaagtttcgagtagatgtttgcacctaatttaatgtgctaacccagtctaatgaattgagtatttccccaactcagtgcttggcttttggatgatgaagtggcttaaaatcatgaccttgagaagttctattccatcagatcaggccctacttataaacttcttaaagttggcatttgatacatggagctattgtgagctgtgctgtgacaacatctttggatggttttttaaattgtagagtcctaaaaactggcttggtcaccaaagcaatacaaatgctgtccttatgtgtatacgaaatccttatgcttgcctcactttgttttaaaggcacctaatagtattctgcttaatacttaacagtttgacagaaaagttcatttcaatcctataaatcaatgacctttctaattacaaatattcactgattctgtaaacaatgacaaactttcatttgaataacattttatagtacatttttctatgaaatgtgaagtgctttcaaaaggttgccttatgccatggtaataaaaacgttttagagcatgtgcgttgtcaaaagtcactaaggtatgttctttgtagaaaagcacacagctgagagtttacagtggataggactctgccctatcccacccacacatctaggtttcaggctgtgtctgtctggagaaatgtgtcagtgcttacctatatctctttggcactccaatctcatggaagccagtctgctggcttccaactgcaaatacctgtgactctttgcccaagggtcatctttccctgttacagcccatttagcccaggcaagaaaagccaggaatttaatatctcccaccttcccatgagtggctttcaacccatgatcaatagggatgattcctgcatgcctcagctcccctgaccagcagtgagataacgccaagatattttctacactgtctcccagagcttcccagtaagattgcactcgcgttgcccacagtggttacgtgctgaacaatgcatccttattgactcccttctctatctcacttttcaatgtccctactggtaattcccaggatcacttcccaaataaaccatttatacttaaatctgtgtctttggggtctgtctctggggaaatccaactcaggacatactgagactgattcccacaaaggcacagtgtgggttagctgcagatgttgggatctgagaagctgaagaactggatagaatgggcaatgatgtagaaccactgtaggcttctgaacaagagaagggcgtgttgttaaaggaaaatgatcctcgcttttgtctacagttcactttgcatcaaggggaggggtgtggctgggaagagcctggagcctagggaatcgagttttatcactattgttatggttatctaggggcaggtaaagagaggttggattagtggagaggaggttaaaatgaaaataaggaatatttcttttttttttttttgagatggagtttcactctttttgcccaggctggagtgcaatggcacgatctcggctcaccacaacctccgcctcctgggttcaagtgattctcctgcctcagcctcctgagtagctgggattacaggcatgtgccaccacgcccagctaattttgtatatttagtagagacggggtttctccatgttggtaaggctggtctcaaactcctgacctcaggtgatctgcccacctcggcctcccagagtgctgggattacaggtgtgagccaccgcatctggccaaaaatacggaatgtttctaaggtacatgatggagaatcagtgaggattgatgttgactgagttggtaatggaggagcaaagaggagggaggaagcaaaaataacagtcttggagaactgggagtatggcagtgcccttagcggttttgatctatgtctaatttgtagcctctgcttacagggtaatatttattggtcttgagaatttcctgaagcaaccttacagttcatcagaatagggctcatttctccaaaagaacagaccctgtgaaacctctggagatatagtcagtatttcatatgagtttatggatttttcttcagccttccaatacatataaaattacttatctctcttttctctgcactgaaatcctccaacatgccttttccctgagtgaataaaaaacacgagcttttcttaacaatagaccttctaatgagtgagcagagccacatttttagtatgtccaagtcagaatctgtttaacaattggtggccgtctctcaacattgcagctagtgacagcctcatttacactggttcaatgaagatactgaaatgttctcggccagacagtggaagtgaacttacactttcaccagtcctcacttagcacagattttcaagccacttaacacctttcaagtgtctgaaagctaatagaatgctcaacacaaggctcccctgacttttacagctgcccagaatttttatttattatatgtctgtgattatttatttatttttgctaagaagaaaacagagtgatcttacacactgataactgaggaagcatttcacagctggaccttatgtttttttttcaaagaacagagttctctgagctctaaacaaaacttcttatcagacaattaccaatatattttactattttaattttgcttttcagcttattgattaaatattcagtgtggaggaatgggcattcagccttaaaatgatgtaattttgttacatatgaaaacagcaaaggacaatatgtcactatttgaatgagccaggtgaaaagaaactctatgaccttaattcggccatgtggataaggggttctaaaaaattgaaaggagacgtttaggaaaatttgctgaaagaccaaaagaacaataatttcctagggtgataggtttgagctattttctctccaccctagaaatgagccaaagatgtatttacccactgaccccaagaaaatggctgatctccagttggaggagacgaggatctttgcttggccttgttttatggatggaatttttaatattccgtccatacaaacctatgcatgtatttccagaacatttgtgatgaaaaggaaaaattatgttcaccttgataaggtttcttaatattatctcttccactggagaatccagctgattacactgacttccaccaataaccaagctccaactacgacataggtcccaggagtcttaggtagagcaggcaggtggatgaagttggcttgagaattttagtgaccaaaacatggccttcgttaggctatgattttggtgactgaaaaaataataaggctgtggatcattatgtgggccatcagggaagtttcaaagaaagaaccatcttctgaattcattgtgggtcgtattttgtcaccttcttcctactttagtacatacacacacacttctccaagttagaagattcgagttgaagatataagcctgcactatctaattcagttcccacaagccacgtttgtccattgagcaatgggaatgtggtgagtgcagactgaggggtgttgtaaaagacactgtgaatttcaaaaacgtaatggcaagaaaagaaggtaaattagctcattaataattttttatattgattgtaagttgaaatgataatgtttggatatattgagttaaataaatataaaattaatttcaaatttctttttatttcttaatgtggctatcagaagattttaattacatatgttgccaacataatatttctatcagaaagttctggaaataagggacctaagtgcatgtaagggaggagaccaccccttatattgtcttatgcccaatttctgcctccaaagaaagaagaagtaaaaactaaaaggcagaagtgaaatccacaagcagacagcctggcgccacaccctgggccttgtagttaaagatcgacccctgacctaatcagttatttgcataaaaaagcactgtgaggatccctgtcctgttctgttctgttctaattaccggtgtgtgcatcccccagtcacgtaccccctccttgctcaattgatcacaaccctgtcacgcggacccccttagagttgtgagcccttaaaagggacaggaattgcttactcggggagctcggctcttgagacaggagtcttgccgatgctcccggccgaataaaccccttccttctttaactcggtgtctgaggggttttggctgtggctcttcctgctacacatggactgattttcctcttcttcattactttggaaaataaagaaactgaacttcttacttgtaattcatctgttcacccctttaattcacctaacaacattgtacctatgaatctgatataaaatgatgcccataaacccatataattaataaggccagctacttagaaatgttagttcataaattaaatagctttacatatgtttttgaattctacatgcatacacaaaatgattaagaaggtatttattttcttataaattatgaaaattcatatatttcaacttactattttacttataaaagtatgttctattattttattatttgtgtctgttttttccactaaatttgtttcattaataagctaggtttttaaaaacacaattatcatttgacagatgctaaatatctgatttaaatgatacataataagaaataaaggatctagtctcaaagtaaataatactaatttgtaaaagcatctttgtgacatttcagtaatatataataaaactgtattttttaatcaattaggaggctcatattccaatatccctaccctaacacattggcttgggtagaagaattagttggtgagaacagagtcgttgaacaaacagtgactagccatttcccatttaagttgggaactcttaaaatatataaaccattatcctaactatggaaatataaggacatatgcacaaagcatatgtcctctacttccaagaaagcataatatagtagagtggagaaacagagatcactaagccgacaagaactatcactcttatccagatcaatgtactctttttctacatagcagccattttctatgtagcagtcatcatgattttgttaaaataatcatattttatccctcccacttctaccttttaaaatcccaaagtagattttcagtgcacttataataaaatcttaccataacctgcaagacactgcatgatgtgacctctgttgccttttccatttcactccctgtcccctctacccttcacactcaactctccagctgactgatgcctccaggtctttgcctctggtatccctcatcttagtctatttgtgttgctataaagtaatacctgagtgtgagtaatttacaaagaaaagaaatttattagctcacggttctgcaggctgtacaagaagcacggcttcagcatctgcttctaggaggacctcaggctgcttctactcactgcagaaggcaaaagagagccaatgtgtgcaaagattacatgacaaaaggagaagctagagctagtatgtggggaggtgccaggctcttttaaaacaaccaactctcacaggaactaatggagtgagaacccagttgttacaatgagaatgacaccaagccatccatgaagggtctgcccctctgacccaaacacctcccgttaggccccacctctaacattggagaccaaatttcaacatgaaatttggaaaggtcaagcatcaacctattgcatcccctttgcctggaactctctcttaaagcttaagaataatggaaaatacagggagagtcagtcttgtgggcacatctgagttgccttctctggccaccctatctttttttttttttttattatactttaagttttagggtacatgtgcacaacgtgcaggtttgttacatatgtatacatgtgccatgttggtgtactgcacccattaactcgtcatttagcattaggtatatctcctaatgctgtccctcccccctccccccaccccacaacagtgccgggagtgtgatgttccccttcctgtgtccatgtgttctcattgttcaattcccacctatgagtgagaacatgtggtgtttggttttttgtccttgcgatagtttgctgagaatgatggtttccagtttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcaaggtaatttatagattcaatgccatccccatcaagctaccaatgactgtcttcacagaattggaaaaaactactttaaagttcatatggcaccaaaaaagagcccgcattgccaagtcaatcctaagccaaaagaacgaagctggaggcatcacgctacctgacttcaaactgtactacaaggctacagtaaccaaaacagcatggtactggtaccaaaacagtgatatagaccaatggaacagaacagtgccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctacacagcaaaagaaactgccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggccaccctatcttaagtagctcccctgtattcctgacagtgaccttgtatctcactttcctatttaattttctttatattgctaacaactaccccaaattatcttttactttaaatttacctagttatttgttgtctatcccttttcatagaattaagaacacaagcctgatctcttttatttgatcttttttttttccccagacatatcaaaggccctcaataattaaatgctggctgactggatgggtgaatggataagatagtttcataagtgtaaaggcagagagaattcagagtaggggaggaaatagagatggtatctaatccagattagaagttttctgaaggatatagtacgtcagctggtacatatgaataagcgggaagtggccaggcaatcagcaaagggtttaaacttctgggcaaaagagcaagagtctggtggctaaaaagaggctgtcatgctcagagaactactaaaagttgagtcaagctgcagtaagaagtgggagtaatgctgagacctgaggacaggtagccaggaaggagcccaccagttcataagaggcaactgcatgagaagcctgatttggatggtattgtaaccccaaatgtctgaacgttctgcaatatgaagcatgctttgcatgtcagcttgcttactccagctcagtgtttaagctgcttatgagattgtaaactgaacaaaatcagggccgtcccccaccccttggattcttctttacttataacacaatgccttatacaaggtgggcttccagcaaatgcctattgagttgaattgagtcctttctcttattatttttcacactgttatctgaactgatatttggggctgtctagactattctgagatatcacacaaagtgcaagaataactcatgctccattgatcctccataatagttactttgaataaatatggaggacggacatgcacaataaactgacatgctccacagcttttgactatggaagaataccatactgacaataaagaaggcccggaagggagctttcagagatgtggataagatatttctcccccttgagttgaaacaggaaaagggaatccagttcttggtatattggatttaaaaaaaaaaaaaatacactcgtctcaaaagtctgcatccttgcaagaattatcaattctgaaatgcctgttcattttccacagattagtcttcattagacacaattttagctaggtattcaattgcatttgtttgagtaggtaagtagaaaccaagtctcagtgatcagaattttagtacagagctaacttaagttgtttgcttttgtctcttcaacgttagaaggacaaatggtgccttgattttacaccacttcataaataattttctagagccacattttttacaacagactgaaacaaacaggcctagatctggttctgattattatgacagagaaatgtgaatacaatagagaaatgacatattaatcatagtgatgtttgatatgctcacttggaatgtgaactaacaggttcaggtaccccagaaatatctcaaagacttcttttatagggctgattccccccttattatggaaagctatatttttcctatatattttattaattccctatgtctttatttcagtgtagaacatattcctttaatcattagcatgcaccaacccctccccaaaaaaagcacaagctaaagcaaatttatagaaacccaacttgaattctaactcagcaactcaaaaccattggacatttctaaattttttatgtaaccatgacttcatctgaaattctgttgcttacacgtcttgctacttcttaagctcacttttctaaaatgatgaatgctcatataaaaggcaaaacaaggcagccctgtagagacatgttaagtctacaagtcaattgatttcctatgagaaacttttgagctagggaagcagggactcaggaaagttttgtttcttgttagatgccagctgaatagaattaaatatattgtcacaccttgaatattaaaatatcctggctggatgcagtggctcacacttataatcatagcattttgggagcctgaggcaagaggatcacttgagctcatgagttcaagaccagcatgggaaacatagtgagatcttgtctctataaaaaatattaaaaattagccaggcatggtggcacatgcttgtgatcccagctacccaggaggctgaggtaggaggatcacttgagcccaggagttcaaggcttcagtgagcagtgactgggccactgcacttcagcctgggagacagagggagagatccccgtctcaaaacaacaacaacacaatatcttgaacttcagatgttttaatagagacagtgtgatacatgtgtacatagggaagaaactagcccacggagttcactattacataaaacagcatggtttacctaccattgcttttattaaaagtttttgtttttccatgttcatgttgtttttggaaatatattgtaaagtaatattgtcaagtaaataattttctcaagggaaaaataacaattagaaaagaggtaagacccctttgctctgatacccttaaccaagttaattgaggagagaagtagaaataggaagagaagaagagaggaaggacagaaaaaaagaaaatatatgagggtaaaataacatcactgcaggagatgttgcccgtgccctgttcacattggaccttaacactttactatgctccacacaatttttagcttccagtatctgcaactctgttgcaggggttcttttccattatagtggaaaccttcctggtcagcagaagactactctgcacatggcaggctgccagtgacaagaaattaacatcccttaaaacctttccctcaatcagtgattctctagtgtatcaataccccagctcccctcctcttggctgccataattctaagctttctcttatacaccacatctcagagcttctctgtagcagtaagctccagtgacccattgtagtagctggcttaataattcacccattattgattgctttgcctctctgtgttacttcaccactctttccatgctccctgggatcacctcctaaataaaccatttgaacttatatcctagtcttaacactatgcccctggtggaacacaaataagataactactatttctgttcataacagtttgtccttggactccattcattagaattgtaatggcttctattattaagacctgtacaaactttttcatgatactgcacttacctgggttatgcattctccctgctttcttcaatatccatcacaggtgtttcataaatattttctgagtgtagactaattccaccagtgcaaagcttttgctacagcacagttctggcacacagtctgtgcttactaaatgttttatcagatgaagtgtgatgattatgcctttggcagtggaaaggtctttattcaacttttaattatgtccagaagaatggcagaatatgtagtgtttgcaaccatctggttgaaatccacctgcttacacaggtatttcagggcagagggggtactttatccatcttagcatctgggaataatttatcatagaggccaacttgcaaaatcagtcactctggatgcctcatccctttcaaatgaaaaggatttggcttcaagtgctggacatggaaactgagaatgcagtgactcatttctttaaaaatgtgaatatgagagaggaagatttttatcactcaaagtgcagcacggtgagagctcgcctgagttaggtaaaatgcacataacttattttatggacacctctctaaagtgccttaaagcttaaaggataaagaacccagtgggttttcgttttgttatatgccccaaggctgaaactctgtggcatattttaacagagtttttaaatggcaaaacaatagttctttttttttttaatgtagtctaaaataaaatggaactccagacctgtgtgcgacagctggtgttcatatgacactgttagatgcctccttttatcccaatctcagtctcccttgggtagacaagaaatgggagagaatagtcaaaagtaagaaacacttctacttgagtgacatcttcctgatcgtagcagaatgaaatattatgacagttgtccaggtagttctaagttttgaaattttttactaaaatattcagatataatggaagcaaggacttcctggaaaaattatctcctcaattatcttttttaagttgaagttatatgagtctgacttttagacttctagtcaaattatgcaacttttcttcttctgccagtcagcttgttgccactgataagtaaaatgggattctagaagttaacagggtttgagtttttttccatgatgttgattattagatttcaaaacttttaaatcttaagtttatttacataattagtcaattgtaacctgaatatctgaggagttattaatgtgtcaagctgacattatttaatcatcagaaaagctatctttccttccccagtccatctctccgtctccctctgcgtgtgtgtgtttgtgtgtgtgtatctctttctgtctctgtctctctctacatatattcattatatgtatataatacatatacatcacatatatgatcctatttggcctgacatactatacccataggactaacttaagtaatatgagaagagtgagaagagttcatggtaggaaggtcaatgaattgatatattgcaaattatctggtagataatgcagctgcttcttccacttagcaaataatgttttctgtaagtgttctgtgatcaagacatagcctgcaatgacttttgtatgctaggtcaactccatcgaacccccaaattgtactggaatcagactttttcattaattcatgcaaaccagcctgaattctactggcaaccatgaaacacttacctatccatacatggcatagtcttcgaattctcatttgtttctgattttaaccaaaaaaaaaatagattttcatcatttacaagccatagcaatacacgttgcagtcactaagctaaactcattacatgcaagtagattaatcattcatagaccttatagcttatcaaaagaccttgataactcccacggcttcttccttctgctccttcgatatttgacaagcaaacttatatctgatactgatagatgatcaaccctcttgttagtttgaccccaggcagcaggacttcattagctccagtctgtactaggcattacgatggtaagtccagatgcaaagaaaggatatagcaggatccctgtctcccatgtacttatggccttgctggagaaagaggactttaacctgtaaaagaccaagacaattttgtgaaaacagatagaaactctggtagtgataaattgataaaccctgatggtagagactttgtctaatggcttaaatgaggtgccatgttcgtgccagcgagaattcaatacctacttgtccacgcacaaaaaaaaacgatgctcgttacctgatctcatggagttcaatgagagcggaggctaagcctttgtaagttctcaagattcttctcacaagttgtgggctcaattaacatgtcttgttatagaacttttattggttggtgtttgatctggttatccatactgtacacaaaagtcgctgtcagctgaagagggaatgcttcaagtactcagttttctcttaaatcaaagcaaagataaacttcttataattatttttctgcaaaccaatttataaagcgcactcatcccaataataagtgacaagaaagaaagagataggctgtgtttatttgaaatatcctactattcctctgatacagcactgttgttagattcctttaggaaatattagaatctttctcacaattgatcagcctccctgaatgtgcccaccaaaaaattagttcttcagagcagattttgtattggcagtttgctaaacacgatactttcttctgaaactcacttatgcaagcttgaatggtatctaatgagttcataccaaactatgcccaaaatgaaatccaagcctcatttctgacataccattgttcaccatgcccgatatcttactaagttctgttaatttttctttcctaatgcctctcacaactgtttcttctcttaatccctggtgccagtatcttaggttagaccaccaccatatctctcctggatcaccaccacacccttctaatctctctgtctatatttttgccaccatcctcctctccatctcaccctttaaagtccagatgaaggttttaaattgcaattttaattgggttctttcctccctaattagtttcagaataaagcgtaggtgcatcctcagtgtggcctggcctggccctgcccttccttcagccttacttcttgtcattttattatttgaatgccagttacctactggaccacttcttgttcccccaaaagctatgctttctttttcctcgaggattttcatagcagggtctcttctctgctcttccttcatgccttggggaacccttgctcattgttcaggactcagcttacatgttttgtcccaccctgtggtggcttttcctggtccctcaaggctgttgctggaaaggggtcccaacctagaccccaagagagggttcttggaccttcctcaaggaagaattcagggagagtccaaagagtaaagtgaaagccagtttattaagaaagtaaaggaataaaaaaatggctactccatcagcagagcagtggcatgggctgctcgactgagtatacttatagttcttttttgattgtatgctaaacaaattgtgaattattcgtgagtttcctgggaaaagggtgggcaattcccagaaccgagggttcctcccccttttagaccatctagggtaacttccagaagttgccatggcatttgtaaactgtcatggcactgatgaaagtgtcttttaggatgctaatgtattcgaattagtgtataatgagcaatgaggacaaccaggggtcactttcactgccaccttggttttggctggtttgggccagtttctttaccacaacctgttttatcagcaagatctttatgacccctatcttgtgctgacctcttatctcatcctgtgatttagaatgccttaacctcctggggatgcagcccagcaggtctcagcctcattttacccagtctctattcaggatgaagtcactctggttgaaactcctctgaaaagactggctttagtatcctgctgatatgctcctggagccagtgccctgtgctaatagattctatcacagcactgaccacgctctaatgatagcaattgttaacttgtttgtttctctcaccaagaagtcacgaactgtggctttttttggttatgcattccctgcagctggtactatgtgccagttcagcaaatatttgcttgacaaatgaagtcaaagccgtgaagttattacacaactagtaattggagaagcagggattcaaaagcaagctctttgataccatgtgacgcaacaatctctctgccaggtatatgcccaaagtagatgaaatcactaccttgtaaagatatctgcattttcatgttcattgcagcattatttgcaatagctgggttctgaaaacaacctgtaaattgatggatgaatgcacaaagaaaatgtggtgtaaatctgtatctatatatttatatatataaaaatatatatatttatatatacaaacatatataaatatttacatagtatagagagatatcaatatatattttatatataagtatataaatatatatacttatatataaatataaatatataagtatataattatataaatgtatataaataaataaatataaatatagataacatatataaaatatttatatatatttatataaatataaataagtatataattatataaatatatataaatatataagtatataaatatatagttatattgatatataaatatatatctatatcgatatatttatatgtcaatataggtacataaacatatatataaaatatacacacacaatggaatattatttagccttaaaatggaaggagatcctgccatttaccacaaaatagatgggcatgaaggacatttatgttaagcaaaataggccagatgcagaagataaattattgcataatctcacttatatgtgcaatctaaaaaaaagttcagatattcagagagagataataaagctatccaggggttgggaagagggggaggaaatggagagatataggtcaacagatacaaagtggcagatatatagaatgaacaactccagagactgaatatacagcatgaaggctacagctaataaaattgaattttggatttttgttaaataagtagatttttgttattctcaccccaataaaaaagaactgtgtgagatgatagatatgttaaatggcttcactgtagtacctattttactatctatatgtatcccataatatcatgttgcaaatcttaaatatacacaatagattttttttttaagcagctctttaaacctcaactataccatgctctatatcctaggagaagcgacactgtgtgctgaagcatgaatgggtacagttaaagtctttccattagccatcctccacccctctgcccgtcttttttctttttggcaggagtagggggtgggggcgaggacagggtcttgctctgttacccaggctgaagtgtagtggcacagtctcactgcagcctcaacctcccaggctcgagtggtcctcccgcctcagccccttgagtatttgggactacaggagcacaccaccacacccagctaatttttattatttttggtagagacagggtctcaccatgttgcctaggctggtctcgaactcctgggctcaagcgatccttcctccttggcctctcaaagtgctgggattacagtcatgaaccactgtgcctgggcccttctgccagtttttagtacagtagtttgaatatttttagaagatgggctgtgtgtctaactaaaacctaatcgagtgatttatgctaaaattgtacctattctcaatggcctgtcagaactgggaataagccctttaaaataaaatcagctttgatatatattttcttaaatgtgttcactgctatcttttctctgcctgagaattctgctaagaaaacctcccagcaaggatagcttgttttaagttttttatagtttctcccattgtcttttcattgtctctgtcactccttaagatgtcatctgagctttattaatatgtatttggtaatttgtattcatgctatatcaacatgagaaataaaagagtctctcagttttagacttcagagccccaagtcgcctgaatatatagccacctaaatatgttgtactcagcattgggactaagcccctgctgttcacattacacaatggagcacctttctgagaggctagcatttacctctccagacatgtgtgccatcaaatagatccacagacacagatccttggtcatactgcaaatatcttctctgtggtttgcctttttattctcttagtagtgtcttaatgaccataaattcttaattttaataaaattcagttcttctcctttatagttacttcgtgtatatatttccttaaagcattgcttgtcttcatattaagttgtacaatattttgtgtaaattattttaaaacatttcttcattttactattttatttaaaatgtagtttctaaatatccagcaattttcctcctttgttttataagtccctcactccgcaggacatattacaaattacttggttgtaatttgtatttctatttaatatttattataaattattagatattttaaaatttagttttgaagacaagaaagtatattgggtgctaataatacatttctgaccctgacatcaccatgatagctttgcattaaatacagtctgggccggatttggaaatgctaacttttagttttcttattgaaataaattgtatatacttgcatgtacagtcaaccctctgaatctgtgggctccatgtctgtagattcaactaaccttggattgaaaatgttcaaaaaatggatagtgtgtccgtattgaccatgtacacgcatctttcttgtcattattctctgaacaatacagtataacaactatttacattgtattaggtactataagtactctagggatgatttaaagtaacaggaggatgtgcatagattatatgcaaatagtatgccatttttaataagaggatggagcattgtggcttttgggatccaagggggtcttagtcttagaaccagtcccctgtggataccgagggacgactgtataccatatgaagagtgtgaaaactgcattattttataggactgcatctttcaatgtaatgtcaggacttgaactgtgcaacagttaggacactcaatctagagccctggaaagtacatgaactacattgaaattctgtcaaataattattatgcgattgctgtttcacttttagtcaagaagcattgaaaaaacaagtagcctcattaatcattgaaaacatcagaatgaactttgaggatcaggaatttagggacatgcagatctggtcaattggccattataatgatacaaattaaagcaaagtccagcagggaaaataatccagcttgaatcctgggatctattcttgtacctttgtggcgtacacttaccagacaacagatctaaaatgtggtgtgtatgttttacaatactatattaatataaactatattaatagtctctaagccaaatgatatgtgatacatcctaaacttttgtttgaatagttgaatttttctttattgttttcatggatagttaatgaaatagttatgataaaatataccatgtttgaagtcataacttaattacatttattaacaagaaatagtaatgtacaggaatgaaactgaaagttattgtgcaatttactattatcttttatggatagaactggttacaagtaacaaatgtaaatttttacatttgcatgtaagaagataagtcctaacagcattattgaatgataacattattgaaataactttaatttcactaaattgatccacatttgctatttatatagagagaagaccaactgtgatttttatatacatatttgaaattatccatcaatatcacatggaatattcaatctggccttttgcgggaggaagaaaggaagagattttagagactaggaaaggacagcaaattaggaaagaaaaccgcagatacagcagataagggaggaagaggtggattatctacctcagtgacaatttacatgctgaattatactaatttccctgtgttctgtgatgctcagtaaatgagactctgctgatgttcctataggccatgaaccagccggcacgttggtttccactacaacacctacaaataaactgctgagttaaaatctattatagcagagaatggcttatgacccacagacaatcattcctcttctaaatatattcacaaatgcctcataaatgtttgcttgggcattttatttagaagcaacatggataaatatttgaaagagtattgctaatgacaaagcaaaagtgaactataaaatagctttaacgatgactttaaaatctgcacttttcaaatcaagcactcactaaggaaagacaggaaaatataagatagcagcaggtgagctcttcgtgtgtgtgtgtgtgtgtgtgtgtgtgtgtgtgtgtgtgtgtgtgtctatagctgtctatgcgaagcaaatcatatttgcaaaataagaccaatatctgctgaatagaaaagagctgcattgaacagacatatctgccagaaaaatctggggttgtaatttaggttttatagtccaagaatgactagattgcttttaaaagcactacttcttcaatgcttttattccattctttgatcaaacatgtcagccaaggaagaaatggtcatttatttcttttgaaagcaggaaaaaaagagatttacattaaatagcggtcatcacggcgttcgtaagtttccaactatttatcaacatgcttggttcgcaactgcaattcacttaattggacttgcatcttcagtaacactgcagcttccatactggaggtggtagagttattctaagccatgggcaggctggtcaaatgtacatatggctgtgtaattgtcagaaaatgtcctcgtgtcagacggggccatggcttatagtgaaaacaatcctgttagtgcttctgcagcatatgaggagacagctccactttattagtgaaattacactggccatggatgactggctgtcttgatcatttacaggccaattgtgaagccactgatgaaatcactgggcagcccaatccaattcagtcattaagacaactggagtaaccagactgtaaaatggttggtctggttatttcttaatgatgtaattggatagaccagagggagatccaattaattgctgagcaattggtggctatggtggtctcactgataagctcagctgtcagtgatggacttgaattgactgtacagcttcctgatcaattgtacaagttactcttaccaagctgggggttggggagaattgatttaattttggtgatttcattgagcccactgataaatcacatatcttaagtgtctctctctctctctctctgtgtgcgtgtgtgtgtttgtgtatgtgaatgtgtgtgttattttctcaattgcaatatatttgtgagatatcagtgatatataatgctattttaagatatggttattttaccttgccagtgtatatttcattggaaaagtctataggctcttgtagagatctgtagggcaatttgttactttctagaataggaggggaaatgcaagcttgaatgaaaattatgtgtttagaaggcgggaaagcaaagtattttttcttcaccctttatgcccagtctgtgaagttcactgcatggttactgcagcctattcatgacatagtgatgctagatattcttctgctttgctgagtggcctgtgaaaagagcttaacaccagtgtagcctggcatgaggaagtaaatgattggtataatattttggggaacaaatatgcagccgatgagtatttcagctctcccccacccattaagagacactgtccatggaaatatcccttcaaagaaaagacttagttactcatgcaagctcttcttggccagggcctgtgtgaggacttaattcactatatccaccactcaaccatgcctggaatagacgctcattaatgtttgttgatttagtgaaggaatatgttcttaagataaatttctttctgagagttgatgccaaataagtataaaaaggtacataactgtggagtttttacttattctaagaaaataaataaatttatgagttggaagtgtgacttgttgaggtgatttaggccacctgtgatttttctaatgatggtccattgacaagtgccaatctttgacaatgttctcaccaggccaaagcacaatgagaaaaacataagaataatggttttgagagattaaaaatgtctgcaaattttttgtcatgccccccactgaaaggtggcatctctttccttttctcttaaatctgggcagcccttgtgactactgaaccaggttaagcctaaactttagggggactagaagcttctgcctcctatgttgaatgcttgctcttgagacactcccttccaggacacaggcatcatactatgaaaagctcaagccacatggcaaagccacacatagatgctctggtccaaggctgaagctgatctcccagccaatgccagctgacttacattgagacccattgagacccaagctgaactcagtccacccatccaattgtagacatgataaaatggtttttttttgttgttggtttttttttttcgagacagagcctcgctctgttgcccaggttggagtacagtggcccaatcttggctcactgcaagctccgcctcctgggttcaagccagataaaatggttttttaaagccactacatttcaggtcaagttgttcccagcaatagatagatactaatgatatgtattgaatatatactacaacaatgatgcatattctcctttgtaagaattgtcacctctgattttctgaggattagctattcagagacgctgtagttcttgctttcttggtgttggaatatcctttctttttggcatgatggctagagaagatatcagtgatgtatgtagatgtatgtttttaactggaataagaaaaagttgagattcatgaagagcagtcaatgttttcagcacccttcatttatctataaaattcaaattctctgcccaaatccaacttcacaccctctgcaggaattccccctcatccagggccatcctgaagattaccaaacttctgctcaacctattccagtggaaacaactgattcatcagaaggcagtgctgtctgcctttaaacatctgtgattataaagaaatacagtaatataaaactttgatcataaagagaagttttgcacagatatttgtaattcttaatttaaagaaatattccgatattgttaattacacacaccaacacatttgcaaggaatctctggacttcagatacctcacttcaaattgtattatttcacattattgttgttgtctctgataagggaatacgcatgggggatgggaagtggcagtgggaggtgttggggagggaaaggtgaaaaaacaccacatttactgaaaacatactatgtgctaagttctactgcatatgccagactctcaagaacttggaggttttagaagttctttaatgcagacatttccataaagatgtatgttttccctacaaatcaaacattttatgaataaacattatttaactcaaagctttttttaagcttttgaatggagaagaagtctcatctaccttgaaacattattgctatgaaattattttattccaaagtcaatggatttgttttttacaaaaagcttaagtaaaggcactcctgaacacaaattcttttatcaaactacttttgtcacaaaggtgtttagtataatgcgttataaattatatgagtgcaaaatatgaagaggaaaatgtgtctgtacaatggacattaggaaaaatataagtaacaaaataatgtgacgtgaagcttatctttgaaatgatacggcatttacttctaccatatgtgtttgctacggtccttctaaagttctcagcatttttaataacaaaaaatgtggctgacatatgaactttagctcttacagcattaacatattccagtactagtgaacagttaaaggaataataagtgaaataaggtgtgtttgtcattattagtgagaatatggagccctgaattatggtaaatagtgaactaattgccttaaaaatggtagaacttttcttttgggtagctgtttcttgaaagccattttcttccttagaaactgttttcaaaaactgccatcttcctcacagatataaccttcattccagcagtcattggtctataacaaagcttttcaaagataagaagaaaaactatggtagtacttcagtgaatgtcacttgactgcagactcatttttctaatttttcagaataaagatatccatgatttatacccaattcaagaggagactttggatcatttcaataaatattaagggagattatgtatataagatattatttagataaaaggattattaaatacctcagataccttttcctatgacacacctgttaaagaaacaaaatattctgtacaagtctactcttcataggaaataagatgaaaattgcaagaagtttcttcaaaacccacctgatgttctttgaaataagatgaaaattgcaagaagtttcttcaaaacctacctgacattctttgaaatggaagaaaaaaatgctatgtttacgtacatacctttagaagaagaataaatattattctccttgtccgttgcctttccctcttttgtttatagggatggggttgaggggggactttgggagaggtctccagaattaatgaatggaatcaatcatctagaaagttatcagcatgaactaaactcttaacagcagactgtggaggtgctgactacctttcatgctaattgactgccaaggcaccctaactagccatttgcatagggcattgtggtagatgtggctctgaaatgtgcatctccacagcaatggagcaagttcacctgcctgaagaattgacagagttgctagcccagaatgcatggcttctggagacttctcaggaatttcagctggatggtccagctcacttatcatactaataccaggttagaacagttaccttagaatctttgtacattaccagagaaaatctagaagtacaatgcttcagttagacaggaggaataagttctggaggtctattgtacagaatgatggctgtaattaataatgtgttgtgtatttggaaattgctaagagagtagattgaaatattcttatcacaaaaatgataaggatatgaggtgatgaatattagttagcttgattcaatcattccacaatgtatacatatatcaaaacatcacattgtataccataaatgtatctttctcatttatcagtttaataaaatatggataaaacttagtttggggacaagtagggtcatttcacattgccttggtttctttttggtgataagtgtttacaacatatatgaaagtagaaaaaagtttgatggccaaatttaaacttacctctcatatgttccagaaacaccactgcctcccctcaaaatgatcagattctactctacttccgttcaaaggtacaaggtaacaaatatactgacatttgctcttgaagggaagaaaatcagatttctgccaatttaaagccatgaacaaatgtcagaattaagatcagtttgttggatgagtttgtaattccacatgcaaaagctaaaatattttcacggtggattttactgtcctatgtggcaatgcacccatgagtagattgggttcactgggtacattccaaagggccatctaaaatgtgttttctggttttcgtcattacatgttaagtttttgaacactagtggtcatatattacctgtgttcagcaacacgctgcttatactgttgttgaaaaactggttaacatttagtaggcacttaaatatctattgaataaatagtggggatgcatgactgcattacatgctttaatctcaggacatcctttaagttcagaaataatcctatgagctgtgattgttcaatggtttgtaaataccataattttttagagaagattgttattttaaaatgttggtgtttcacctgcctgttatttacaaacaattcttttcaatgatgttcaataattattcaattaaaaattaccttttgccccagtcagtatttaggtggagtagattgttctggtatttatctgattattatcggaaaaaaaaaactgaagttgaactggtgtcagagtggatatatatttacaggaaaaggatattactgttcctcaaaaagcattcctagaactttgcctatgctgcttgaagctattgcttaacagtttcttcccatcttatactcagattttaccatgtcccttagctgtaaggttttctccttctctcctatcccaggaaatccattgcagcaacttatcagtagaacacatcgtattccgtgttgtctcaccagttgatggtttaattagcacctagttacaaactaagtagaatcattcatggaaaacatggatctaaaaacaaaacacaaatcattcatccaggccgtagatactataaactacgtgtaatgacaactgtgatctcctggtcccaccccttgaccagcaagctgtcctgaagatgctgtttgaagattctcaagtaggctccagttggttccttcattcaaaggcccaaattatggggagctcatctttgatcctctttaagttctacattcaataaacttattcattcattcattatttgttttactcattcaaaaagcatatgaagtgccagagacacagagaaagcattctccacagtcacactcttaagttcctttgggtgagggtggcaagcagtggacataacaggtgaatgaaaaattgcaaaacaatatgataagtgttacagctgagctatacaagggcaatgtgagcatacagaagggatttaactaactcagcctagaggagcatggttaaagcaggagttgaatctggaaggaagaaattttgaaggaaggatgaagaaaaagactttgcagactcaaggaataggatgcacacagctgcaaggcaaaatgatggcatgttccagagtctgcaggcaggtgtgtatgaacagaacggaggacgggtttgaggggatggaggaaaggtgccagacaattaaggacattgtattctcatgaaagtgcaagtggtgggcagccatatatgtgttgtgggacccattgccacagtggacaacataggtggagatcatgtcaacgctaagtgtttctgctttgtatatccatacttcaataaaacgttcccaaatcaagggtaacccagttggaaatagagcaagaagaggcatccacagcatacaaagtcacaaggtggggctgctttcataggataagtaagtgaaaaccttttaaatctctctgaatcaatacatgccagtataactccgatcttccataaagctttctaaatatctaggctggtgtcaatatctaaaattccatagccagggttttatctttgtctcaatactgttcattcatttaatatggatccctgaggagttggaatgcactaaatcccataggtcaagtcgtttggcaaagagagtaagtaagcattaaacgacacagaatgaggagcggaagtacccaaaactatgaatgaagactcccaaaggggagtatttgcacattgacctgggagaatccctcttttgtgtgtgagcttgtagaataaaagaaatcagtcactctgagaccaaaataccttgtcctgtgttgtttgttactggatatcaaattctctaaacttctgttttttcaacttaagtcatattatgaaaaggaaattaaatgtatccatcaaatgagataatatacatcaagctatttgcaaacaaaaaacaccatacaaatttaaatgactatcatttatgtgttatagatatgtaggcgtatataacacattagaagttgatgttttttcttagaatatttgcagtgtgatagtcatatagcattcttttctgttcagggaaaggcctttgttgggccatgtggtctaatcaggctgtttgactagatttaaagactcaaagtatttatattatttaggactaacacaaattcaaaatgggaattttgaaatatgaagacattggatgctactaagccagtcatgaatgcccttttaaaacataataataacaccctggatttcaatgacagtgatcctagagctcctttatgggtgatgttctctcatgtttcttaattaccacaggtcatatagaccccatttgcaaaaagagttcatgaggctgagctgtgttatgtaccttgaccaaagtaatatcaaggaaggtcagtcctgagtctattagattgttgtgatttgctcttctgccaggtgcagctaaaggcatttttcctaccttagtcagagatgtgctggcttgaagaactaactcatgaaacctgaatacctgaagagttagtgcaatgtctggagggaggagcctaatgcttgcatgtgtctccctggcttgacccatccataaaaaaagatgtatgcagaatgtctttgctgagccaagggtgacctgcaccagctcttcctccaccttcattcattttgtgcctattcctttcatggtccatcctcctgactgcttcagcccctgcccagcttggaggttctgcttgcctgttctgtctctgacagtccatgctcacaacttgagcttctcttctcccttgacattgcttgaattgtgcccaggattttgtcttcttcctcctggcctcaggaccttgtgaacacacctgactgttgtgacctagtcactcctcagactctgcctctgaactatcaggtgctggatagcaaagccagtccagtgtccctggcatttatttgggaagcaatcatgttaaagaaaaataaaatccatcttcaggtgacctattcccaactcctgatttcatgtgctgatatgtttgtgttgtttagcaaactctcacagaaaatgttatctaaatgtcacaccgctatctcaagggtttgttggacttaatatctaagccttacactgagactagagctgagaatccagattagttttacctacgtatgttctttgtcggacctgcatgatttgattttatccaaatggaaaaaatggttcaaaatggaaaaaagttccaatactgagaatatggatgtcagtggccaaataatatgttgcattttaattttttttgcagtcctcagtgaatttttatgtgtctctctgcgtgtgtggcatgtgaaggaacacaaagttagaaataagagagggagacaacctgtggggtggccacattccagggtctgatcctctttggggatactgtgatatgctgcccagatcctcccatcagtgctaaagaagacagccaagtgggagacagtgaggcaacctaaatgttctcaatggcaggaaaccattaccagccctggaatggaaaaaatacagggggtggtgctgtcacctgcccagaagccaaggtcattagacaggagctgagaccatgaagggatgaactgtcccatgtagactggaacttcagaaaaagtacagccattgccacaggtgcccctgaaacagaaagagagaggaaaaaacacccatacatattcccgtttataaattgccaggcttctgtcagttattcatgttgtaacaggaagctacggggccatgtcaccagggacatgtgcatccctggcacacaaagccgaacagggcatggagccgagggtgaagagacaagtgacaggcaaatggcacctgctcagtcaaatctctgagagtgcagcctggaacccgcatgttcaacaagttgtccagaccattcttatgtgcaccaacatttgataacctttccgtaacatggaaaatcccttaaattgccaggctcttataattgcaaaacaattatagtcatcaattctgatggaaggaagatgttgaattttgtgagcctttccccttctctgattgttttaaccaaatatgataaataacctgtggaatatacgacaaaatgtcccttaataacaaatttctccctttcagtgtaaaattatctggaaaaaagtctcctttttgcacagccccttgggagccattaacatggcattctacagtaatccaaaatgtgcagaagaaagtgaggtacatttacttaaaattagctccacagtgtagtacaactatttccagcattcatcattgttaatgactataattgatggctgaaaatagaaccctcaaatgagaataatgtccaaattcacacacgcacactaattgggaattgttcagcctgtgagcatggcagccagatgcaccccacacttcgacttctttcttcaattcagttctacactgtacttcattaatgcttaaggctttaaaccgctgcccttgtttaacacatgacagtttttatgtgtggaaatgttctatgcatgtaggggtgtgggaagcagacacaaacattctgatttaatccactggaattctgtggcaaatcagctcaaaatgccttagggaaagatcctgtattggctttaattgttcctaatatgaaggattgagaaacgtgctttgagtgcttttgggtttatatgtaaactaggaagggaaaataagaaaatggaatgaacatagcaaagaaagatattcttaaaacagggctgttgctctttatagaaaataaaggtttaaagcagccaagtacttgatttaccaagcaggactgactcatcttcatcagtggagatccccaatacctaaggtacatttttaatataagaaattaacatcattataaatagatttctgtgttgctgttctccaaattcatctcattaaaaacgtgaccattaattgatgatcatccttgagtcactcactcttatcgtcactggtttcttggtctgatactaagaggaggccaggatgtgcagtaaactgtatttatttccagtgcttcccctttccaggtgactttgggtaactcctgcaaagtctgatcttcaggcccctcaattaaaatgataggattggaattagattatctacccagctctttgaatactgcaattcagtgagtctataacacagaaacttacctgtgtcctgtaaagttaaattagattttgccttcaccgcttactataaagcatacagaattactcgttgttatttaaacacgctgcaaaaattagctgggtgtggtggtgggcacctgtaatcccagctactcgggaggctgaggcacgagaatccctcgaacccaggaggcagaggttgcagtgagctgagattgcaccactgcactcccgtctgggcgacagagctagactctgtctcaaataaaacaaaacaaaataaaataaaataacacaccgcgtattttccagcatttgtagtttttctcaagcctaaatcccattcccaactaccaagtacctctttatttcttaaggccaagatcaaatcctatggttttcattgccttatccgttgccccggttagattcacccctctccctttgtgctgccatagcttccccatatacattgcttgcatctcatcatatacaagtctgtccagtttcaattaatttttgtttattatcgactgactcctctacttaacgaggatttcttcaatggttattattctatctaaccatctttgcaaccctgaaggttggcacatattagacactctgatgatttaaacagtttcatagatttttttgcttaaacattttgtagtaaaacattttgttttgttttgtaaaaaatgtttatttttgttagttaaacattttgtggtagccagccttaaccatggccccatgactctcccccactgacattcatggctcatgaatatcgcactcccctcccatttcaatcatggctaacgatgaggccaagagaatatggtagaagcgatgatgtttcctttttgaggctaagttataaaaggcttttgcagcttctggctggtcttgtgtacctctccctctggaggaagccaaccttcatgccattaggatactcaagcaaccctgcagacaatctcaattggagaggatccagggcctcctgccaatagccagcatcaaattctcagccatgtgaataccactttgtaaacaaacctttcaatctttgtcagtcctacagatagctgtagcctcaatatttgactaaaacctgttagccaagccatttccaaattcctatagaaactgaaagataataaataataattattaattcagtaattacttattgaaattatttattatttggcaatacataattaatacaaatttcttcctccccccttttccatgggaaccaatattatggagtcaaaaaaaatgggtttgccattgaaatcttgcctgatacttaatatcaatatgaataatgtattatgaatagtaacagctattggcattattattaatgtattagcaccattaactattatattattcattctaattaacatagccagatgattggtatgcaattaatgtagtaaattagtaataatatcattggtatgttgttaaaacactaatgtttggatgacaatactaacaataattattaatatcaattattatatctatttgtaagtgatagaataattataatattatatctacatgtatgtgaaatattatgatccctatttgaataatgaggaaactgaagcttagagcagttaatttgtccaaagtcaatcaactcgtataataatgagttatgactccaggctagattcatcttaagcatcaaaaactagcactagagctttgagtttcctcatctacacaattggtacagcaatacttaatatgcactgtgcttgtggggattaaatgagatgaaacctgtaaagttgcttgcagaatgcctagaaaagccacatgcatcaaatgccagtttatctcccttccctccacaatctgctctgtttctaagaagcccctgggaacacaggccattaggcagagctgtcagaagcagaagcctcagatcaagtccatttccacatgggaccccaggtcctgaaattgtgcaatgagggtgactcttatatttcctgtggaagaagtaaggttacaactcagtcttttgcctttctcaaactcaggctgagtatctaataatagtgacgttttaccttttgatagtactctggagattacagaactgtttccattttctacttaggagagggtaaatggatttgatgcagatgtgaatcagattggccatggaatgaaagttggaaagtatttgtggcaacaaaccccttatgactgacacacacactccttccttaaaacctttatcttctgcagaagcaatctcattacaaccaattggtggtcagttacacagaatggagtcataagagtcattatctatgggatgttttttcctttattcacaatgaaggcataatctttttagagagaaatacaattctctccagatatataacaaaatatatctactgatgttggtttagtttcatgtggttgacaagaaaaagcattcatttacctgaatacgcagctcaattttaaaataatttctgtaattttattataattcacagagctgcttttattcattttacaaattgctttcaaagcataaatgatgtattgaaagggattgactatccgtaatagctctgatgtgtgagtggctggtggacttaccactttaacatgatctggcatcaacctccatgagctgcgcagtaagaatagcaataccaaattgtggtaaacctcaagagttttcaaggaagcaatatgggtctaattgggcagaagcttagcaagtagaccacagctatttctttgtagaaagtccagttgtgtattacaaagattgtgcctataaggtttgccttgctaaatggaaaccacaaggaatgggcctttggatgtcttcttgaatcagagcattaaagggacttagctggagttcaataaggataacatttttttctttgcaaaaatatgagctgtgtgcaccagcacacatatgtacttggtctgcaggcttctctctaggttgccaagaaaataggttttgatggacagggctgtaccatgaaggatagtagacgaaaaaaaagatattaaaggaagccccctttttaacctttaaacaaagttaaacatgcagtgtttcttaatattgtttaaccataaatgccttttcaaaagtataatatgcactaagatttgctctgtggaacttgcttgggtaatcggatcttttaaaagagagagaaattctgtggagtgagacacagaaaatcttattgaatgggaccccttttctccgtgtgggaatgaactggtctctcaactttctccttagctaactgtctgcaacactacagactcgtatctacctccaacatgagcctctcttgtcctcacaagaacccctcgagggctctactgtgtcctcagtagcagacactgtatcatgttcaggtgcttgtctgtttttttgatcactagccccatcaatctgtttttttccaacttgccgcattctacacattttcctcctcaggtcaccaaagtgcagcctttcatttctacctccagaaactcaagagtttctggaaacttgatttgccccatattattaacaaaacaattttattaacatatatattggcctctgagctgcttctgaccacagacaccttaggttcctcttggttacaaaagctgtggtctatctctgatgatgtacgaaagaagctgatgcttatcctgtggttgttggtcctaacctcctgtttagtctttttgtaatttgaatctcatgcaacttttgtgatactcttagcccatcatcaactgcttagcccatcatcaattgaaaataatcagatatcctaaaatcatcagccagcgaacttttcagattgttggcacttgagtttttgtagcactaagtaggaactatcaccttaccccagtgtcataaatctatgggactaaaaattttgagaaaaactcatataccgtattatattcaatactccagagatctactcaggttaattttcttgtcaagattgggcagcttttgacctagaatatcaagctttttttttactatggggctgtggtacattccattctttccttttaatttagtaacacttggatttcctctctaataaggaacaaagtaaacaataaactcagaagctcccaatgctcttcagtgtaggagaaattatttcacattaccagggaagagaaggaagttgcttttatcctaatagtgatattctcatttcttatctttctatgcaaaatgtttaatgtttccatcttgtggagcccttaattacatccttaccagatgtgatgcaaaaattaagcatcaattagctttttctggattgcacacatccttaaattctgttttcagatcactgcaacttaactttgtgatttatattggaaagatagctttgggggttcatttcacttcattattcttcagcaattgtatttcatccccttagctatttctatggcaattgtgctctgttgagaagagattgaccagtgttgctacatcacaatgactgtgagataaaatccggtagagcacagctagattttgatgagtttttggatcccacacgcacaaaagcagcataggaaaataaaagtgataagcatcattttttgcattcaaagttgttctgatataagacagactgaaccttttaaataaatacatcaataaaatggactaatgcaactgtaagcttgtagtctggtttcatttgataaaagcatttataaaaataagaatgatttcccagaagtcagttagtataagaggtacaatggaaagcccagacagtttggaggacggctttgggtactcaactcatacatgtgtatgcatatgtaaactgtgtgcttatatatggatatgactatagatatagacatatgcactgtcttttgcccaaattatttcctgttatgtttattggtaatatttgcctcattctacatgtagaattcctatttcagcttaaatctcaaatgttagtgaaagcctaattttttatccatcatttctcaaaaaaggctccttacaatatatctcttcatgaagagaagaaacagaagcatcccttgagaggaaatatagcattacacttgtgagcaaggactatggacaagattgcccaagttcgtctctttcatcacatgatgaaccgaaccattggcccccgttctcagtggctctgtatgcctatatccttgccatggtctcattgtgagaaaagagtacatcccgattccttgactttttccttggctctgtgacttctgtcggcttactgaaaggtgacggaagtgaggctaagttagttccaaggctgggcctcgtaagaccttgtgcattttcactttctgctcttggcactgccatgagactattgacttgataactcattagtccagaggggataagaaacatgtgaaacagaattgccccagcccacctatggtacaaagcccagctgccccaactgtcatagcctaaatcagaagctcccatccattctcagtctagatttggtgaacctcagctgaccacatatcatctataagaagtataatgaaaatcccagatatttgaggggctgctttggataataacaacacaaacatatatatgaatgtgtgtagttcatatgtctatatatcatcattgtgagaatcattctgtattattatattacattgtaattttgtgattatttattatgttgcaatagctgaaaatgtgaccacctgttatctgtgtaacttcaggcaacttacttaaactttttctgcctcagttccctcatctatgaaatagaaacaagaattatctactggctcctagaattgtagcacatattaataagttaatttataattaaatttattagactaatgcctgaaaaatagaaactgataaatgaatattacctatgattattttatcattcttctatattcactcctaaaattttctgtgggaccactgtgaagtcaaactgctagagaaagtctggcactgtggccatgacagtggctcaagccaccacagaatgtctgaccagcccatgaggatttgacaagcagcagttacagcatctatccagcgaggacaataagaactactttacctgttggcagaaaacaaagaggaatattttatttcccaccacatcttcacttcccatgttatggtgagctggtcagaaattagtgccataattcttcagctttgcaacttgccggggacaacatgtgtggttggttgactccaaatttttctcagcttcccctgccctcttaaggagtggcaaaaaccaaaaagcatcctcctttaactcaaaaattgttatcaattcacaaaaaaagatcttttagatctcgacttatatttgctaataaactatggcttcaaaaaatgtcataaattatgccatgctcacctatatctacttccacagagttgaacctggatgtaaaggacaaaatattattataagcccaaaggcattgtgacatcttaaaattttattgactgtgaaataaaagaattccatgactgaagaaatggctactgactgtataaatttcttaaactagtatcaagtaaaatataaacacattgactaactctactggaaaaaaatggaagctataaaaaaattcatccataaactcttccaaggcaagctgtgaaagactccagagcatgccaaatgttacccacattagttaaattatagtaagaatccccgcgcactaagtctgagagggattgtttttgtccttatgaagaaaaataaatatgtttttcaacaagaaaaccttctgaaggctgttgaaattttaatcttttaaaaaatggttttaccacatagcaaaacctcaaagttgtatttcacttttaagactctcaaagcattccatccttgcaatttcattttatcctcatctcacatctggatatcctggtgagatggaatgtctttctctgtgtttcacatgctggccttgatcatgggtggcccacactaagttgtgagaaacagaatgagctaagcaaagggaaaacagaagggatgttaaggcagagaatgatcaagggccgtggccaaggaaatacaagcgtattttattacattttcaggcatcagcatctaatcatgatgttggggtggtccaggatgggggggtgtattagtccattctcacatcgccataaagaaatacctgagactgggtaatttaaaagaaaagaggtttacttggctcaaaattctgtaagctgtgcaggaagcatcatgctggaatctgcctgggttctggggaggccttaggaagcttacagtcatgtcagaagccaaaggggaagtaggcacgtcttacatggtggaagcaagagagcaagtgagggggagttgctgcacacttttaaataaccagagctcgtaagaactcacattgtgagaacagtatttacgggatggtgctaagacattcatgagaaatccacccccatgattcactcacctcccaccaggccctacctccaacactggagattacaatgcaatgtaagatgtaggtagggacacagagccaaaccatgtcaagggaggagacttagaatgatggtgggaggtctaggctgtggtgcttgactagaagattctggtgacagtttattaagggagaggtagtttgtgatgggttcagctagatatccacccctggaaaatagagatgcaaaaaattaaacaagagggttcagttctaccccatttcctcttatatagtaatgggacttggactgaattcaaggggtagaaaataggaagcaaagaccagggaagagatgaacaggaattgggtaggtgtgttgggcttggttggaagaggaggttgaaaagacactagacactatggtcccaagagaagagtccatgaggtgaggagtctgatgcaagactctattcctggggccatagcagcacaatccagcaagagagtgacacaaggcaacatttaactctttcttgaccctatttcttagtattaaggaccacctactgtcagggtaggctttgtgacttcccaatgccggtggagctggacctacaggtgcatgccacgtctttggggtccctaggatatacactgatggagctgttgggaaagggacagcatccagaatgtgagaataataggccacagaaacttcatattacgcccatttatttcaaagatgagaaaacagaggttcttagtggctctatgatgtatttgcagtcaggacccagaaccaatgagccaaaaatcccgagacctttcatcctttttttcatcttttttttttttttgcctctgtaagacaccaaagaaattggctaatgttaatttgcttcttctccagttcccttgcttatcacattaatgggaatatcagaaaccacaaaaagcatcatgttggttgcattgctatttgaacatcacaaataatttgttttaaattctactgttactcatttttgatgcttggattagaaagatggatgtacggatagatggttggatggggggtgggtggatggatagatagatagatagatagatagatagatagagaaatagacagacaaatctgaattgtaagtggtttggacacagtgcatataccacagctataaggcacgtaacactttacctcctttgccctggggggttgtgtcgtctctcaagaagtcaacatctggctttagttgataagctaggtgattaactttttatatcaagatccactgcccaaaataatttgactagtgataaactaaatttttatgcagaattatttagtagagtaggcacctagaaaagagacaggaaacagtagactagatttcagtcacgacccttttcctcaccacttggtggcactgagctcaccacttaaccttgctgtaccacactcacctccactctggacactatgagtgtaatagtgacttaaatgaggtaatcaacatgaaaaacactttgacaatgaaacagagttgcatgctgatgccaagtggccttgttattatatgcatttatcatcaccatttccctattcttattaactgactgggttagaacaagttcaaagaaggcaggagctcattcctggaagttgactctactttgttatttaggtaaagtgtgactaccgctttttgtaaatgtgcactgtgagcagagtgacatttttcatgtggatggtttataccagttcatgttcgtgtgttgacagttatgttaattctatgtgatattttccctccagtgcttttgcttttgaaacagcataataaagtgacttctgctaaataaataggcctgttcacaataactgatacttaagtgaatttatgcaggaggtattttggtcttgtggaccaaactaactagctgcaaatcgattaacttcaaggatccagcagagtatttaggataatttctgaagtgcaaatgtaaaagtcatggtagaattttttttggcatatgtgtagaatttctaccatgggcccatttaaaaaatcaatatcataataattacatcaaagcaaaagtaacagagcattatgtgcatgatcagaaagctgcaactgagaggaaagtccaaccactccaggaaaatgagaaacgtgtaattaacatctgcaatttgcattgctccctgacactcctgaatttttatgacaaatcatgctgtaacctttgtaagttggacatcagtaatggttgttttttcatggttttaaagtcaggaatatgaagcatcctctttcacaatcactcatccctactattgccttatatggataatctcaatcctaccccttacaacccacctcactgtagtattctctcttgccaaacatctagcatgcctgcacatatatgagtagcaaaaatgtacatttcttaaagagaaaactgtgaataggagcagaaacctagaacatgtaaatgttttgctgctgttgccaataaagggactgacagaatcactcaatgaatcaactgactaggactgcatttggtgacattatacaaattccctaggaggagcaggtctgccaagagttatgagagatgctatggtaatataattatgaactccctgcagtcaggaagcttataatccaggtgggaaatgacgaacacataaaatgtcatcatcaacctatcaaacatcctttcttcccctgggtcccggtaactgctatcatttagtgagcatttgctgtgtgctcaacacaatgcagacattaattcatttactcccccagatagcctagtgaggtaattgaacatgtaagccccatttttacggacatgaaaactgagctttagtgaggttaagcaacttgcccaagattatgcaactagtaagtggtgacagtgggatttgtaagtaagctcccagacttcaccgtacacctagtgttgtactatttatgaagggtcttatcttttctgtccaggaaagtctcctggaaaacaagacaatttctgtcgtacacatcctgtgtccttctcaacccccaccattgtttgcagaatgaatgtatacattcaacttaatatttattgagtgtcggctctatatttgatacacaatggcacataaaaggataaggaaaactacaaggcagtacaaaaatgcctcattaaagaccaggatgcatgccagctgcatatttttttttatcagaaatatcatgatgaagaatagcctttttatagaaagcataaaaatatgttgcaagaaggttattttatgaaaataacattaaactgtaattgacaattacctagaagattcataagtggcatcacacttcatggcagtctttcacatcatactctagtcagctagtgaaacaactgctgttaaagtcaaggttttggaggtatactgagttgaagagtgtgttccccctaaattcatgtctactgaaatctcagaatgtgaccctgtttggaatagaacctttgcagatataattagtaaagttgaggtcacgctggattaaggtagatcctaattccaatgactgctgttcttataagaagatcacctgaagaatctctgatcacctccataaaaatgtccaggactgaggaatactccctaaaaattctgattctcagcaccacttcaaacgcacaactcataatatctatgaagacggtcagtaactaggatgtttactaagcacactagaagttttttgctcattacagtttgaaaactatggctttgggcaggatgaagatgtagaagacgtagtgcctttctctactgggttcaccttgatcaaggaaatgagtcgtggaaagcagcatagcaaggaataatcttacttgtggcagtaaccccctgtcgaagtacaaaagaaagagaccaccatgaatgggagcaaactagataagtgtactaagaattcacaaaattttatcttggccttcaatttcagtaagcacagcaatctaaacatgtccaataatagttttgcatgcagaccaaattaagccttgataagagtgatagctaccatattttcaacagttgctatgtgataattacttcacacacatcatttctttgaatattctggacaaccctaccctacagtattggtctattattagccctatttaactaatgaaaacagagtttagagaagttaagtgattcactggaagtggccaatcccacacacaaaactgtgaccaatgaaatttaagcctattctcttgatccgaacctcctctcccacaaaacagaacacctctttttaagccatgtggcctgtctaaaacaggttttccacgtggactggatagacttgaagtcagagagtaaaaatgttatttcttctaggagcttcaattttatataaacatttagggtaagaaacactttttatcctaacataggcataaacatataaataattgggtagaattgtaaaatatggaatgcagttttaaaataaaagatgtatgttgaaggaaactttgcaattgaccagaacttctcaggctatcctccatgaactggagtgtggaagggtccccatttagaatattcagccttcgaggatacttcatggtaaacattgtgaaataatctcataggttccctcactggttttgtcccacactagactgcttgggatgtcacagactttcattagttgctttaattagttcttttcaattgattcctgtgttagtttgccccacccctccaacatagtctacaaagtgaaggcagcacacacttttattgacttgagacagcagcgattttctctcatctagttatcctgacctttctttctactgcattttcactgtgggtggcaatgatgatatggctttagtccatttttggcagaacaaaggaatttcctggttggacaccaaaaggaaaaaacggtttttccacgactaagcagtatcaagaatatgccataacaagccttacgtaagccatggctcatgcagtctagagccgtcctgttaaccaactcacacccactggctagagagaaaacatggcgaaatgtcagagctgctaactgagatagaaaacatacaggctgccacatgactagaacatatggtgacccaacatggcagcagcgagaccctcggcatcaagaaaaaacaacaaaataactccttaaaaacaagggctttttctaaagtggaccttgacatagtcaaaaaaaaaattatatatatatatatatatatatatatatatatatatatatggcttcttcacatccaggttcccaaagatgtaacttaggaactaggtacattttaaataatttgttgtccagaatgtatctgtttcacaactcagaaattaaattacatagaaaaaatagaatccttcttaaagtttttcaatgaatacatcatcagtggatctttccaaatattttttacagctgttcacagaattaaattttagctttcttctcctcaacatttccaaaagtataacgtagaggattggtttgtttttaatgaataaatcattcggctaagcccatggaacaaattcatacttaaggtagatggtttagagtggactttcggcagcattattttaggaatgtatctctctaagcaattgagtggtgactctaaattgtgccaatatgccaattccatttgcatatctttgtaatttggactcttcctctcctgctgaaagatggttggataaaacattattggatacagcacaaacgcaaataaagcatcgttttcctgctgaaatgcaaaccaaggctttattttgactggccttaaattttgacctgtaactggcattggaaacatcagtgaaaaccgagaaacagccactgcagcatttagcgtcacagatgctggagcagaatcgagtttagaaaataaacttttaagggattacagcagcagacgttatataacaagattagtataatgggtgggacatctgttggctgttttcagaaagccatcattctattaccctctactaaaataatcttagtggatacctgactgttattgttctttttttccatatacccccagtgagaaaggttgacatttagttgacatttctatgccgtagtcttctcttctttctttttatgtttttgtttttatttggttagttattcttttgtcattgttttaattgttcattttgcttaaaagggaaaaaaagactgtcttactacaaaattagtatcataattgttttttctcagttagtgttcagggtggctttaccttacacataggaaccaacatacctcagagtatagcagagaagtgttcaatagctattaattgttttctttccctttccattcccttgagaagattttgatattcataataaatgttgttttaaaacataaagcttataacactgaattttaccttaagactataatagctgaaggagaaattcttttggaagttaaaatatgttgaaacatctgtatcaatcactctctctctctctttctctctctctcccatgcaaatgtaccaatacaccatgcattctggctccatgccactaagtcatgattttccacctgtaatggattcccagcccccgtgcaggatctggtgcagtgtgccgaagagaggccaaagtcactgtacaagccagggggaggggggggtcatcttcctcaaggattagtaacgattaggaagaaaagcattgtctttatatacagccaagcatgaatattatagatactacattactaaaagaccatgtgacaaaacccaaatttaaataaaattttgtagggggcattttgggcatcatcccaagttcccgagggagacttaatagccctcaggaatatttgcatataaacatttgaaaagcacttaattaattgataagaccactggaagttgtgagttcaattttcaaaatatgaagcagacaatgttgtggaggatggacaacctacagagggtaagagggaggagaggaaaagctatttcttccgcagagagaaagccagggggcccatgtttctacctttttcctcaagtggtctttccttttggggtccctaagtcagttagtagtcataattaggtcactcagagcccactgatacagtggagagatatgacagaccttttctcatatcctccagttggctacactgattacaagctggaaagatgactaaaaaggggtgtctcctccagggatctaccgtctagctgaggggcatgttcctctatctggcatttaaagagagagatgatatgaaatagctacaagttcataaagatataaagcgacaatcaaaggtttggaacagctcatgcgtgttgggggaggtagaggctagggtggctaataggagaggcacagatgtaactcaccattttccttcctttcttttatgttcacacatgcacacacacactcacacacacagcactgttgccaccagaatgcttttggtttgtgctttcacattgtagaggacatgaacctatggaaaattactcaagggagattgttctgttgaggtttgccttttgaacgaaaagattctttcttgcaggagtgggagggacatcagcttgagaaaaacagcttttgtcctcacaaaaatgctcttttggaagatatgttaatgagcttcctttgaactgtaaatggcatctgcatgcacgtcagatgctaatggaaatgtcgagaaaacgataaggcacaggacgattgcacggttatgcagtgggccccgttccttcgagcatcgtgaccaggctgcggagccaccttgtgacttggcatagcattctcattttgagtggagatttttgtttctcccactgatggcatcttttgaaagtcaagatgtgttggctttataaagcactatcctccctgggcaacctcataagcagcaatgaatgacaattcttccttgaaatttttaattacttcaacaaagaaagtaattattaacttttgtctctgaaccacctctgcagatattcttaatcaaataaaagaaagaggaagcagagctttctgagaagcaggaggatgaaatagacaataggggtctgcagctggattgcggggtgacatgagcgctgcatgtgtgctggataaacaatggctccatggttggaagggtaatttcatgtcatagactagatggcgaggaagaagtttgagtcaagagacctattcttggcactgtcttcttcgtgtaagggtaccaagggcaccatgggagtgatggcaaagtataggcagcagcccgtaccttatcggagtgagaagatgaattacattgaattaacacttgataggctgaatgttgagagatgaagtggatatctgaccaattttctcctcacctcttgatttggattctcccaaaagcagaccctaagacaagaattagagtgcaggtagattatctgtggatcatgcagaggtgaggagagttgacacagagcatgccaccaagagcatcaccctgggaaaccaggcatttatccctctggagaactctgggatctctcccccaagggtgatcgaacagggggatttaaacatcaactcccgtcagtctttggttgaggctgccagggtgacaggcattaattttccaaactccagctcactagatatttgctcagagcctgccagcactatgaaagccctcaggcaaagaagtgcaggtgcttggccattgtctggctcacacttactacttagacccacgggaacatgaacagggcacctcagtgctgccacacctccagactgtgtgggcccgcttatcttttatggatttgctaacaaaccatcaagtaatccatttctcacatagaaggagatctgtaactcttatctagaaggatctacctagcattaggcaagatagacatctgcagagatgtgtcttggctctgggtggctttggccatgtgagatttaccctcacagctgatggcagtcactgcacggttgccctcggagccagtttcctgtcctttgaacagagtccacagagaactttgagagacacgtttcccaatggtcagtgtcggatggggccccaatctcaacaaatctgttgctgtcactttgttagggttacatgtatagcgtatattgacttcaagtgctcttttacaaaacaagtcctgacttcttaccactggtcagccaaatgctaaatatggtcactcctgaaattactagtaagcaaggagcgggtagcagtcactgttggacagagctcaggtggccggcttcatgtgtgattggctgctgccactcagaacgttggaaatgatggaaaaaatgggcatgggaagaaaagaattcagattgtcaaaaatagagcgttattgtcctaggtcaagtgtccatggaagtagactgagaggggaattgcaagtaggaagtttatcggattatgttcctgaatcatacctgggtggagaggaaacatgtgagaagcagggttgggagaagttgaactgtgatccggtcacagcaaaggcttcggctgatcccaacaggggctcaggagtggggaaagtgtcttagtctactcaggctgccatcataaagtaccacagactgggtggcttaaataacagaaatttattttctcatagctctggaggctagaaggcaaatatgaaggtgtcagcagggggcatttcttctgaggtttctctccttggctggcagatggccatcttccccctgtgtctttacatggtcttccctctgtgcatgtccgtgtccaaacctcctcttctgatgagaaaacttgttatatgggattagggcctatccccgtgacctcattttactgcattacttctttcaaaactctgtcttcaaatatagtcacattctgagatactgggggttaggacttttatgactgaatatggaggagacacactttggcccagaatagatggcccttccgagctgcatcaaattgagggaagggggtctgggccttgaggctactccgtgagtcagtcattggatgcaggctgacttcaggaagagagaagcagcgtgggtgaggtgcctgcttcagcagaacacagtcctctgagagccactccttggagctgtcagtcaccagcacctccagcaagggaaggatgatgtgcattgtcctgaagggaggggcagccaccacgagcacacggcagcttcctctttaatcgtgaaaagaaagcccattttttatctttgactggcatttcccctcagtctctcccaggatcatctctttggatacaagggcagaacaggtcatgcttgctgtgctagaatatagaacggcaggccctaagcctgtgtgtgtgtgcacgtgtctgttccacactaaacatatggagcagcttcaaggaccacgacagatgtgtcgtttgtgaaattttgatcaatatgaggcaggctcggaaattaacttgtgtgaatgagcctccagctcaagccaaaataactcttggctcctcagatgcatggccatttttcttattgagttgaagaaaagtcaagaagagcaatttatcaaaacaaaacaggaagattctgaattctgctgccacagagtaatgacagatatactggctttgcaaaaaagccccccaaaataaaggatcctttttatgcccatagaagcaattttaaaatgcaaaaatgtactttgagagtttgtggattataaatgttttccaattcacccaaacatctctgggaacatggggagaaaaattttcccattctgtaatttggagattgaagtagcaggttctgtggtgttgtgcacaagtgcgaacatggctaatactttcacgaagaagaacaatgatattcggtgacatttgacaaagatattaaaatctcagaatacggactcctatggggtcttgtgaaatctttatccgttacaccatctccactatcagcttacctgtttcccgtttatctcattggctgatatgaccagacaaaaacagagctgcttatatataccatggcctattttcatgaatgtttcttttaagatagaatttctcataaccagcctgggcaacatagcaagactctgtctgtacaaatattttttaaaaaattagccaggcatggtgtggcacacacctgtagacccagctactcaagaggttgaggagggaggactccttgatttcaggagttctaggctgcagtgagctatgtttgcaccactgcactccagccggaaggacagcatgagattctatctctaaaataataataataatagtaataataacatgattttcactataacagataaaaaaggtgcccctgatattctcatctggctatacctcgtcttaacctggcttacaaggtcagggtagaaataaaggactcagcaagtgaacactgattttatttccatgccagcaccagggtaggtgttttaggtaccttatgaataataactatgcaaacaagcaactgatgtttatggagcatttactctatgtcaggccctttgctgaggactttatgtagaatttctatgtggtcattataatcaacggtggcaggcaggattctaagatgatctttcagattcctaagtcatggtgtacacagacctcccaattttccaaaccataatactgtaaagggattttgaagacgtaattaaggtctcaaatcttaaaatagggagattatctaggtgggcctaacttcatcacatgagttctttaaatttggaacagatgtggaggaagtcagagaatcaacactgagaaggagttgacatgcctttgctggcttgaggatggaggcagaaatatggcaaggaatgcaggaggcctccaggagctgagctgtcctccagctgtcaaccagcaaggaaatgaagacccccatcctgcaactgcaaggaactgaattctaccaccaatgaaaaggagtttagaagtggatttctctcctgagcctccagacaagggctcaattcagctgacaccttgattttagcctgtaacaccctgaatagacagaacccagtcatgcaatgtcagactttagacttacagaactgtgagctaattagtaggtgtgttttaaggcactaacccccagaggtcaatgtctccattttagagatgagcagactgaggcttacaaaacttaagtaacttgttcaaggtcacaggtaaatggtaaagtcaagtagggacacaggcagctgcttccatggagggaactgcgtgggaggctgaagttcaaaacagcctccaagatgccaatatgatcgcccctaggtgtgcacatcttgttcagttttctccccttcagggtgcgtagaaccttcaaatatgatggggtagtcactctgttgattaggaaaagagatttccacagagggaataaaggtattgaatcagtctggctaattacaaacaggtggacttgactaattaggtgggcttttagaaggaacgtagaggtgggaggtagagaaagtgatagaggcacactcttgctggcgtggaagaaaaagagcgctcgtgtcctgaactgctttggggaccatatggcaaggaaatgcaggtggcctctagaagataaaagccatccctggtcaacacctagcaggaaaatggtgacctcagtcctgcaactgcaagggatcaaattctgccaaaagctctaatgggcttggaagaggattccaagcctgaggtgaggactctagtgcaactaacactttgattgcagcttttgagactcaaagcagaggacccaactaggttgggcctggactttcagccaactgtgaaactgtgagataataaagtgttgttgttttaagccattaattctgcggtgatttgtcatgtggcagcagaaaactgacatgctgggagaagagcagattgctctcttttgcctcacttggtgggagaggagggactaggacccaggcaccccaatttcttgttcttaattaatctgtagtgattgcttccctttgctgctctgtttatccctgagttactctgagtactggggaaacttcacttatcctggtcctccaacctctcaaaacctgtctttgtacaaatttgatacttaagctttgaaatttaattcacttattaagcagcagccactgttttatgaaatcatcccatccaaccctgcactggtgagactgttgatttctctttcatgaaggctgggacttaagcccagctgtccatcaggctatatttacccaggatagccctccatcagtcctcagttaaagcagcatttgcatcacaccagatctctaaatgttggttgttggggaagcaaattacattcatcagaatccattcattctcctcgtatcactgaacacaggataatcttggctgtgtcagctgccctatgactggtggctctgaaaaatggaggttggctgcagatactccaaacctgcttcgctgtgtcaccctcttcagggccagtggatatgatgctggaaaagattaatggaacatatgtcatcacatttatggggtaggaaacccccaactgtggattaatagatatcttggtgaaagacatacatctttactcctttatgcctcgatgggtgagctacagttggctgcagtgaaaatacacagagagattacctttaggaggtcagcttgtaaaggacttttttcaaccctgaggtcaacaaaaatagatttttgattgttgaccaagagagctgtaacataggacttttaacctttaaaaaaattcttattgaagtataacatacagaaaagaacacagttcctgagtgcacagcttgatgaattttcacaaactgaacacatccagggagccagcatccagatcaaaaaaccaggatcccaggcatttccctaggtctctttgcaccaaccctccaccccagggtaattgttacattaacttctaactccatcgatgattttgcctctttctataaggtttttgaactttataaaaatgaaatcatccagtgtgtcctcttttttttctgggttctgttatacaacattatgcttgtgagatttgcccgtattattttgtatggttataaattttttgttctcattggtttttaatattccattatatgagtacatcgtaatttatccattctatcatttatggacatttaagtagcttccaatttggagatattgcaaatagtgctgctatgaacattctagtgtgtgtcttttggtgaatatatttgtaggttctactaggtatctatgtaggagtgaaattgctaggttataagacatgtacatattcagctaatttactatgtactgccaaataattttccaaagaggtttccaatttttattctcaaaagcagtctatgaaagttcctgtcagtctatatctttgtcttatatcaagtataagacaatacttgatattgtcttttcattttaaaaagctgttagtttttaatacatcctagtttagagggcatcattgttgctactgtgaaacgattaagcactctatatgaaaactgggctgaagagccattgtactcaacatagtatcattggataagatgtcagttggtgacaataatgcctcatgccctttatatagtgcttttgtttttcttttttatagagtgctttgcaaaaccatctaggtttctctgtatttctgttctcagctcttctggcaaacttaaaggaaagtcctccgaaatatcttatgtttttggttctagaactaagtacccttgaaaactatctgccacatacctacattttagtcaaatctgtttgtctaaacatatactctgtggatatttacagagctcctattatgtgtcaggacctatgctatgcactggtgatgcaaagatgagtgccacctgattcttcatgaggttccagtttaagacataaagtgaactgtcagattgttagttctaaaaatattaatgttgttttttgtattattttctattacattttagactagggaatcatctgagtttattgacagcttgttcataaaagagcaaattattttaaatatacaaagttgctttaattacaagcggggatggaaactttaggaagttaaccaagaagatgggccgggaccaacaaaagttcatcgaaaaagaagtaattggaatttgagaagccttgacagattgcacacctgtaacaaagaacattgttattctttgtacttcattgctcttctctacataatattcactgaaatgatattgaagattacatcagctggagttaagtcagataagcagaatccttgaatgatatgggttaatggatttattgcagggattagatcttatacaattgtgggagaaactgggaaagtaacattccacaaggggatgattgactgaatagaaaagcttctaaccggggcccatggaatggagctggtgaagatgtctatggaagtcccttgcctgtccatctggacagggccagaagtatgtcagcagggcagatgataaaagaggaagtaggaaagctgcatgcaaagcgggagagaacaaagacaaatgaaagtcacaagggaaaactggaatccacagagatccacaggcccatatatctgtctctcactgattggaaccccaaagctgtgatgtcctgccgaaggatccagtgctcttgctgcagaacttcatgtgggcccagcccagctccaagaacatgtggcagaagaaccatcaagaactggagaagctgtggggccagctgctactccacacccatgtgataagcaacagcatgcatgatcgcccaagccctgcacccaccttcctggcacaaagtctctgactgcacttctgccctacaaatctcatggaaatttctctgtggccagccctaacccagaaccattcagagaaatgcaacttcagcttaactaacttttgacatagactgtaacagaggcatagaaagaaagaaagaaaaaaactatagagatgagataattccatcttttcttgagaaagatgtaaaaactagggtgaggagagatgatggcttgtccgatgtcacagaactagtgacaggcctagaaactcaattctgtgtgtgtgtctctaggtgatatcacagaaaaaacaaacaaacaatctctggatgtgaggttcatgcactgtctttgtatagtccaagccactcaagaggtttgcttgaccctagaaatttgagtccatcctggcaacatagcaagactccatctctaatgtatttaaaacattaaaaataaattctaaaaaagaagacacctgagtttttgccttaattgattgcttgggccttgggaaaaaaaaaatcactcgattcctggactcatgttttctataagtgaatggcatataggctaggcccaacaaattggaaatgatcactttatatctgatgaataaatgaatgaatacaatctctcaagaaccactatttcacaaaattattttactgcctaacatttaaaaaaaaatgaaacaatgctcctgggcctcaatagcgaggcattcttataggttctcatgaaatttatctggggctagtatggggcatatgggccctttttcctttgtacaagtcagatttccaatctctcagccatataacaattagactttctcctcacccactgtgacttcttttttacttattcagtctgggcttttcagtaggagtcaagtactacatagctggaaaaacaagagactctggaaaaacagttacagggagaagctggaagaatatcagatttctagttatgtattttgatggttagctcatgaatttgaaatcagcatttagcaggattgacctgtttcccgctggtgtgacattagctgggatggctcaaaggcctggagttgaaataatctaaagtctacctactttcagtgagggtagttggatccatattgtctctctgcttcctcatggcatggtggttgggtacaagagcgaggctcccaagaagaccaggcagaaactgtatcacctcatggattacaaagttatacagcatcatttctatcatagtcataggcttcccagattcaagaggtggaattacagttgacccttgaacaatgtgagggtgagtggtgactatccccagtgcagtcaaaaatccatgtataacttttgactccccaggtacttaactactaatagcctactattgactagaagccttacagataacataaagattgattaacacatattttgtatgttatatgtattatatagctgtattcttacaataaagtaagttagagaaagaaaatgttattaagaaaatcataaggaagagaaaatatatttactgttcatgagatggaagtggatcatcataaaggtcttcatccttattgtcttcacattgagtgggctgaggaggaagaggaaggggggtaggtatactttctcaggggtggtagaggtggaggaagtggaagaggaagcagaagaggcaggcatgatctgcttaacttttactgaaaaaaatccacatataagtagacctgtgcagctcaaacctgtgttgctcaaggaataactgtagatcccatttcccaatgaggggagtatcattattacactgtaagaagagctgtgggatggaaagcgcatcgcatgccatcttggaagacacagtctgccacaagcactgatcagtacccatggtgcattcataaacacggagcttgtcaactatatgagctcttgttcaacaataaccccagagaatatgtttgtgcacgcttataataaatacatacacatatacatacataataagtacttagtgaataagactaattcttggattcaccttgcttccaagacattttccgtgttatgcctaagggtaagggcagggaattgggccactcaattaatttaaactaaaaagtgtttcactgtcaccatccccgcgcttttttttttttttctgggaaaataagttgggctgctgagttttggacttaaatcatttccatggcaacagagcctaaatgataaaaggcagattatagttccttccaatatttgaaatgtctgtatatggtctgcatggctgaggcaggcagatcacgaggtcaggagatcgagaccatcctggctaacacggtgaaaccctgtctctactaaaaatacaaaaaattagccgggcatggtggcatgtgcctgtagtcccaactactcaggagactgaggcaagagaatcacttgaacctgggaggcggaggtggcagtgagctgagatcgcgccactgccctccaacctgggcagcagagcaagactccatctcaaaaaaacaaacacacacaaaaaagtacacttagcagagaataacattgccattaaccccccatacacaaacacacactcatacacactcatgcacatatttatacacactcacacaagaaacatgagtgttaaatttcataatttatattaaatgattttaagtatgggggaaatgtgtaggaatgacactgttcagccttgtcttctcagatctgcattaagccaaattttcttgttttgattttttgatcggttggttgactttagaaatattctgatcacgtaaagcctgggggaaaaaagtcaacaatcgtagatacagaagtgagaataattacgatctttggaaattccaagtagttcaatgtggcttgagagtcgtttatgtctgagggaggataatgaggctgcacagtcttatttttaattttaggatttttgattatgaagtgtttcaaatatatataaaagtatagaaaatataataatatgagagccatgtacctatccccatagttagcagctattagccatttgccatgtttttctcaaatcccctttctttctaaaggaataaagtattaggtcttcagtcaattccctacttacctcctcctttacctccccaccctccccagaactcatcattctcaaaaagttatgtgcgatattcctgaggcactttaaatttttggaatgtttttgagcagacagcgattcatgaattgggcagctccaaattgcaggtgattctgggctccactgaaggggcatgaagggcttttgtagagttgacatgaaaacaagtcaaagaaaatatatgatcactccaagtggagcaatagccttatttgtatcattccagtggaaagaccctagttagagattagttggcagtgtatgactggctaagcttaaattccttttactgtttacactttggtttgattatgtaagaatccaggatgcttaagccacctcagtctaacagcctcccaattaattatttaaacagtacttatgaatagatccctacactcttgtatctttacgttttgaaagtgtgcagaaatggtatcagagagtatgtatccttttgcaacttgttgctgtcactcaacattatgattttgtgctttagccacaggacataaacatgccatacagagagtggagatgagcattcactattgcacagtttacatttattcaactaaatttagagttcacctggggaatgagttgacaatgacaggtttagcatttatagaaaatgctaatgataggcagataggactggacaccagacacgaaagtgaacacaagaaaaaagaaatgtggttgtttgtactctagttgttccatttcccgtttcccttataatccatcctttgaaggcagttataagggctgcatggtctttgatgattacaggttagaaactgagtgattttccaagaggcagtctaccctaagtgaggtctaggcttgggcagagactaaggagccaaatctctggtcttccgtcagaaaatgtgattgtttataacccagcccctacttcttgcccctgtagatctccttttctactgggaactgtcttactagtgagatctgcatcacacaggtttggagagcagggaggttaggtgggtgacttccatgggggttctttcttgtcctgccatgtgtacacccacttccatttcctactgccacgagaaacacctcatttgatgttctatgcaacttgccagtgagtgcttttcaatttttttatgttgttaaaacaaaataactaaagggttatttatttccaggacacaaaattaagtcactgatttaatcagatatatgtgagctattatgtatactccgtgtctcttctccatttactatattactctctgaatgtttccaagaaactctttacatacagaagttccctcaaaacaaaaaagggactatgcacacattttacttttgaggtggcatttacttattcaataatatctacaaaattaaatgttatatcgaccttgcgtcactgtcagctagttactttttatttctgttgcatttccaagtgtgttaaattaaagcaagtggcttcatgccaactaaactgcatggaagctttttaggccttgttcaaatactaacaggtttgataaatatatttgtctagcaagagtaggacaatgagctctttgtttactgacatactttattgtcattctgctgtatacctctcgtgtggctgttttataggacataaagtctagctatcctgtcggaatctcagatcttatttatagcttgctgcaaagtggcttattgtcatttattatttcttatttgatttatatagcatctttccaccaaagagcccataggtttatttatatacagagtacacacacgcacacacacacacacacattcttacacacatccttgaacttcactcaatgctatgatgtagatagcagtatagaaccaaaaatctgtatgaggcctttccatttgtttttgttctacggctatgtcctggcagggcaattgccatattttttttcactttgagtgttttatcttttgcctctaggtggatcggatcattttctgtgtcttcttagaagttgacttcaaaatctacaaaaagaaaatgaatgagtttttctccgtaggtgagtaaagcaacttcttgttttctttcaaattgaggatggaagaagtggagccgtcacttctattcctattgtttttcatcttcaggactgttacacatggtgatcctgccaacttgtatcatagtttctaagaactgaacaaggtaacagaaaatctaggctgtggaactcttgccccaagaggtcactgtgttgtcttggggaagtcagttcatctcttggttctcggtgcctcacatcaaaactgaggggctaattattaataaaagatttctaaagatgcttcccctggccttaaattgcatgatgtgtgattccttctccaacttgtaagtttaccaggccccatgcctgcatctaccatgttaaataccattgttggaaattgtaagcccatttatattcatagtcagaattcaaacttttcctgcattccatccctattccttcccaagtttctcactccaaatttcaatgcctatagtagcacttctagtgcagtctgagaatggcagtcattcacacttctttttagaaaataggagaaacctcagggttattagagaaccttgagtaatgtatttacatcgattgaatgtgccgttagttggatttgggtaatttggatgtttttctccactctccctcttccagcctattaaggctgaggcttgtttaatgccttgttatttttatggtgccattaaagtcacagtgtccaaagtgctttccttagccatggcaagaatcgcttccaggaaatttcaagctactgtgagcattgttggtacttgcctttcagagagctttcttttgaggtttctgtctccgtctgaagtagtttgtcatatcacaggtgactctggcaggtgggatggagtgaatgaagggtgctgatgcatattcatcctcttaagcagtctatcagagccaaacaataaagaggatgccttgcctgtagatcagagtaggatgtgttctatccagaacagctgtagaaaaccaaaaaaccaatggagatggtcagctctctgctaatgccctaaatggactaagttcttctaagtaatttcaagttcttctccctaattttataattgaaagctggctctgctaagtgcatttaatttaaggcttcaactaaagtattcctctaactgaaacataatgtaaattcctcagattcccatgtgataaagaagaggactgtggttataatctttttctcctcttctttctctttctcctctgcctccttctccttctttcacctttcttcatttttttcaagcatctcagtgttttacagagtggaagcacataacagctatttaataattagttgttgagacgagttgaattaaataaatttttcttgccttaatctgatgacttttattgtttcaatgtccttgctccatttttccttttgacttgctttatgacaatattgagctgattggtacctgtattttgaagtattgttaaaagaaaatgctaattatatttttaaatgtgacttgccatgatgtgtgaagcaaatattctcatgtcttgtcagtatcacatcataattgataagattttataaactttagactccttgagatgtttggaaataatgacatcatattcattttcatgtattctaaaataaagtctgcaggaagccatactaacataaggtaaaaaataattgcataattatgatctaattgatattgaaacaaatatttctatcagcaggtatttccaatgatgcacagtcaaaaagcatactgcaaattttttttaaaatgagacagttttaggagggtaaaatatattaatacttatgcaaacaaattattgtttgaaaaattgctactttaaatacattttaaaatgcattgcagtacatgagcaagtgaaataataaaatcatcctcaatctcacatcaatgctttgaagcacacagtgctcatgaaattattttcagtccatatttacaataggaagtacattttaaactaaatgtcaaaatcctcaaaaattgtgatttctgcaatgttgaagcattaggtatttgaaaattctaaatatgcaatatgaaataagcgtgatgtatgatggaatgtgactactaatatacataatataccttacctgtcattaattttaacttgtgtttaattcataactataccatctttaaattaggatacgtttcttcctacttgccatgtatttccctatagtgcattattattcatgatatctctaactagtgttcataatctttcccaatgcaataatgataatagtttagaaaagaagtcatttttataatcaaacaaaatatttgtgttttggggtactttaatcccatgtctgtaaattttataattgggaatctgagacacaatgcatgataaaacaataaaagactcaaagagatcatactaaaggtatgccacatgcataactactacagttcaataataatggttcaatgataattgctattacagttcaataataatgattaataataatcataattaatatatttaataacataacaataatggttactaataattcaaacctttttgaattgctttctattagccagccacagcattcatttctttacatgggtaaatcactaatcttcatgataactctaagaaaggaggcaccgtattaaccctgtgctgtggttccattgttagggttttttctaatttggtcttaaggtttctctctcttgagaatggccatcagccaggatagtcactctccaggaaagctttgaaaagggttgggggaaaattgggttcagatatgtatgtcaggggagacacagcgaggaagtaaaaccaaaatgcacaaaacagaaggcatttattactcacaagtcccagacaggtgagggatgcccacaggagaccaacaggaagcctggaggtggcagggagcccagccagcaagtgggcagcaagagagagcaagcacctgggggctgtctttattagttctgtatgcaccaccccttaggctttcccatgggggttgtggattggctagtttaaagaaaacactcaggaagcaggaacttacttcgatgattctgacactattagatttttaccatgatcagcagttgtggagtatattgggtttggggtcagctggatgaggaacaagtggaacatatcacaactgatcacacagggagggaagtttaagtaggccaaaggtgacaggatacaactgggtttcaaacaacttatgtcaggcctaagaatggaggctggccaggcacagtggctcatgcctgtagaaggaggattgcttgaatccaggagtttcaggctagcctgggcaacatagcaagaacttggctctacaaaaaataaataaataaaaattagctgagagtggtggtgcatacatacctacagtcccagctactcaggaggctgaagtgggagaatcacttgagctcggggatttgaggctgcagttggctatgattgcaccactgaactccagcctgggtgacgaagcaagaccccatctctaaaaaatataaataaataaataaataaatattgtagagattttaaaaccaaaaggaaaaaaagaaaaaaaaatggatgccaaggcagcaactatatgaaacaaatttatgataccctatgttttaggcatgaaaaacgaggattcagctaggaagcaacagagctgtattttaaaattgagattggcatctgtcattgcccaagtgataataggttcgttttctcagagcatctttagagaaggctgagatcaacttccaggctgcatttggagtattggggaaagtcccatttcatctgctgcccatcatttttcagagatgccatgcttctcttcttctagtacctataaataccttcatggaaacttctaatatgagttgaattagtacttttatcattcatctcaaaattgaattccattcacattatagaggtattgtggtgctattacctgcagatgagcaggtaagtggtaaacgagaagcccaaaggcctttatagcatctacaggacaagatggaaaatggcttatattagtttgtcaggcctctaaaaacaaagtaccacagagcaggcggcttaaaccacagaaatacattttctgattattctggaggctagaagcccaaggccaagtggaggcaagattaatttcttcagaggcctcgctccttggcttgtagttggctgtcttctccctgtactttcaaatgaccttccctctgagtcatttgtgctgtatctttctctttgtataaggataccagtcaaatgggatttggacccactctaattaccttattttaatttaattagctcttaaagatcctatctccaaatacagtcatattctaagatatgagggttaggccttcaacataaaaattcacagggcacaattaagcccataaaattgccccttgtagaaatgctttaagaaactccagggaaagaaaccagcatcgaattttttttcaacagttttatatcttgctgtggggtaaagcacatttgactttttccttccacaagtattatttgaaagtagagtgtggcagctttatggaattatcatacactttggttgcaaataatttatagttacagtgcaccattacatggcctacagcaaataatatttgtatgattcaactcagaaatctctttgttctttacataaaagtgcttgtattttttcagtgtgtagaatttattgtgtgcagttttcactagacgtaaaaaattaaaaaaagaaaagaaaagacaattcccgatctggaatgtggaagtcattttttcttttttttctactagagtcttagtcctgctagagaactgaaggatattaattttccccgtaataacaataaagaacatacggtttataacggtattaaagaatcttgacgttggaagcttaagacttgtcatggtaaaccctccttcactcctccctttaggaaaaaccaacctttgtttactgcaatggttctcaactacgagcgattttgccctcctggggacattctgaggcatttttgtttttcacagctgagggatgggagaggttactgtgctctagtgattagaggccaggggtgctgctaagcattctacagtgcacagtacagcaccctccacaaccctccagcagataattattcagccttaaatggcaatagtgcagaggttgagaggctccatctgctggtactgtctcttaccactcaggccattgccgcagtctttgcctttggattggggttattttacagtgtttcgactgctgatgctttacccataagtaactatctagctggatttggaacatgtaccctcagcctggtctctggcttcctggattcatgaccctcctagtccagacttctggttttgcaccctctctgttcactctgtacccacagatttctatatcttgacctttgttaaccacatacacctgccacccaacccctactctccaggtcctcctgccaccaccccactcctggtatcatttatctattactgcccatgaatctagagtaataatctcagaaaatatgatcattacataggttttatatatctaataaaagtgtggaactaaaggctagtatacagagcaatgaagaacaaattcactaattattttctttatataccttaagcaagtttcattgcttcttgggctaatacttttctttttttttttttttcattagtttggtgaccattggttgataaacttaccttgtgagctcacaaaatatgttttaattttagataccttcaaccccttatcattatctgcatagtaactgattcattcacaatgaaatcacctatgactgaaaaaactaccaactactattttttaaatttgtttttcagagtcagggtcgtactctgtcatctagactggagcgcagtaacgcaatcatactgatcataactcactgcagcctcgaacttctggggctcaagggatcctcctgtttcaacttcctgggtggctgagactacaggcacactccaccatgcccagctaattttatttgtttgtttgttctttagaaacatggtctcaccatgttgcccaggtttgtcttgaactcctgggctcaagtaattctcctgcctcagtttcccaagtctttgggattataggtgtaaaccactatgcccagctctaatctctttaattttttaaccataaaaacaattaaatttgtcaattttgtttccagctttgaaatttatataacgtatacacaatacgcatgtcaactttacttaaatgtgattaacatatatatatatatatatatatatatatagagagagagagagagagagagagagagagcaatgctgggaaaactaataagataggaaaattaattgcaggatatccatgtgctcatcccaaacctgacacctgtttataagaggaagattttatttaagatgaaaaactctatttatgtctatgaaaataattttaaaactatatttaaaaaattaatagaaaaaaagctaaaatattcccaatgttcttgacataaatagtaaaataatgagctatttgacctattaatatttgggacatctatctggtacaacataaaatgataaaccttataaaattgcaagaagtttgtatgccttaaaaatgagcttgcaaaatagtagacataaaacatgtataacaagtgttttgtagttagaactaggtaaacttaatccataggagttataagtttataaattataaactttactggaaatgttttgtggtcttaaatacagattttctttttgtattatatataacataaaagcatatagatgataaagtaaaaccctaagtcaagtttgagaattatatctcgggaacttcttgaatatttaacatatctcaatgtctagctaaaatgcatacattttatttctcaaatattgacagacatgttattaattcactttacttgagtacgtgaacatatttaggttacatgtattttaccttcttagatacagatagcactgagaaagtgtagctttgcataatcatgataaagaaaattctaaattcatattttgataataatttttaatatcttaaatgcatgccaaaatttttaaaacgaaacaaatcaagaaacttctcaaccacgtttcacttattttgacctccttatagtcttccaaacatgtaataaatattattgatatgaatatatctttcgtttattttcccaatcatgaatttctgccatttatttctgtctaaactatacacactcctgcaaggcagctttagttgggttttatattattattattattattattattattatttgacctttttatcttgatctcatcaatgaaaaaataagtttctggagaacagaaattattcctaatattccattgccctttcagaatctggaaaattctaaatatatagtaggtgtttattaatgtaaataaaaacgtaccacgaacctagactgaaactgctacagttggaatgtgtatctcctccaaaactcatgttgaaatttaattgccgttgtaacagtattaagaggtaagacctttaagagtgataggccatgacggctctagcctcatgggagggattggtgtcattataaaagggtgagttcagcctcttgccctttgccttccactttgtgatgtcttccaccatgtgatgatgtagcaggaagaccctcaccagatgccagcactttgatattgggctcctctgtctccaaaactgtgagccaatacatttctgttcattacgtattacctagtctggggtagtctgtagcagcacaaaacagattaagacagagagaatatttaaccaaagtttcaggtaaaaagtcagtttttcctagaaactcttaagtattgttaacacagctagacaagggtatagcactgctttttacgtatttatcaaaattttcaaaaattggctggtcacagtggctcacgcctgcaatcccagcactttgggatgctgaggtgggtggatcacaaggtcaggagtttgagaccagcctggcaatatggtgaaaccccgtctctactaaaaatacaaaaattggccaggcgtggtgataggcgcctgtagtcccagctactcgggatgttgaggcaggagaattgcttgaacccgagaggtggaggttgcagtgagccgagatcacaccattgcactccagtctgggtgacagagcgagactccatctcaaaaaaaaaaaaaaaaaattataaaattaacatttaaagttctcaaaaattaaaaattacttctctgacaaatgggcacaaaactttaaaattttacccaggcagtatttaaattttttcctggatttcacttttaaaaatcttagctctttaaaagcaaacaaaagaaagtactcacattatgtcttctgcatcctccctttacactgattttataagtttatctcatccattatcattcattatctttctatcagttgtcaaatatttgttatgtgcctactatgttcccaaggctgctacattgaaggtactgttcttgtaatagtcctgaagggcacatatcatataaaacagttggaaaacaatattagcaaataatcaagtataacattgatacagtcatagcacccaggaattcagaggcaaatgtgtatgaggaccagattgattgggacagttttcatgaagaatgtggcactttcagtgatctttaaagaatgaacaagggtagagaagttcacgtctggtgttgggtaagcaacatagagggagaatggcagttcagattggaaaaattgtaaaataaagtatgatgcttatatccagtttgtgaagccctgactgagaaattttgacactcttgtcaatgtattatgcaattgagcctaagagtaagtccttggttgagaaataggatagattctatatttaagaaggattaactcaattcacgacttgagagactggcctttcaacaacacccatgccatggattcatcatctgcttttattgagatagtagtgaacaaaggctaaagaaaagtcagtaaattgaccaaagtcacatagttgggtatgtctgagctcaaatcctttccactccgtaatgcttcttcccttagcaatcctgaaaacatggacagttgtttgaagctacttgtctgctaaaaaagccacatattatccatttgcattagtagggctagagctcctgaaaagctagagctcctccaatcatatggtatatccacatgtcctctttccttcttcttcttatctcctctctggtcatcagttttccaagaataataatgaagcacacagtgtcatgagctgctaaggttttctttcctcttgctatgtccgaataatgattggaagatagaagcttgaagaaggggtggtgaattcctgagaaaggtagcaattgtctaataatgaggtcaacagagacaaaagcatctatggtaaaggggaagaaatgctaggcttgttattataagaaatggtctcatcttgtcacagccaccttaacactgtgtggctttgcgcatgttgtttaacctttttctgcttcagttttgtcatgtgcaaacatactaatggaccaattccaaatataaggaatagtaatataaatgaaagttcactagatatgtacaccaagcatcataaatgtttaaatatccatgtttatttcttattacaattttaaaagtaagtagttcaacttttgtaatcatctttgaaaaatatataaaacttcttatcacagaagtaagataggtttatagtgaaaaacagataagcaaaaagaaaaaaatacaaactattttctgtcctataatctggagatgaattacattttgttgcttatccttctgatctttagaaatggaaaatgcaaacagccagaaattagtcttataacttgctatatgtcatttaacataaatcatgaacatttttcacatcattatgaattcttccataacttaattttaatagacccaaagtttactcaaaaccatactattgaacttaggaattatttctgtaaattatttctctatttgcttataaataataatttttaaaaatcatctttgtagttaaatattggcatcatcctcattttaaaaaatacttttctaaaagtggaatcactttttcaaaatatatgcaaaaccaagacacttttgctagtaattgtcaaattgtgcactgtgtttgcagcactgcagttgaatgtcatgtactatacaacttacagggattaccatccacagggacagaaatataaatgcccgagcctagcagtaagcaacctgagtttacattcccatgagtggtacatgagagtttatttttttcctacctttctcagtgggttacatcctactgttttgatgttagcacttttatacatgaaaaaaaggtaattaatgggtaacaacattcatttattttattactaatgtggtttaacatttttccagttatttatctaaatttcttacacaaaattgctgatcataacccttgtacatttttatttcatctttttcttattgatttataagaactctttgtatattaaggttattaatctttcaaatatatgttgcaagtggtttcccagtttgtcatttgcctttgtgatattcttttataaccaaaacagtgagaaaaggtagaaagataagattttaaaatatataaaaaagaaagaaggaaggaaggaaggaaggagaaaagggaagatgaaaggacgaaaagtccgaaggtttaaaaatagaaagaaaagaagaaaccctttttaatgaaagagtgaggttaaaccaaaaactcaaaaatgaccttgattttaagcctatggacttcgcctcacagaaaaccattttatttctaattagattgtttctagttctcctcttcagacattttattattattattttttatttgttattatactttaagttctagggtacagtgcacaatgtgcaggtttgttacataggtatacatgtgccatgttggtttgctgtacccgtcaacttgtcatttaccttaggtatttctcctaacgctatccctcccccagcccccccaccccccaacaggccccagtgtgtgatgttcccctccctgtgtccatgtattctcattgttcaactcccatttatgagtgagaacatgcagcatttggttttctgtccttgtgatgttttgctgagaatgatggttttcagcttcatccatgtccctgcaaaggacatgaactcatcctttttttggctgcatagtattccatggtgtatatgtgccatattttctttatccagtctattattgatggacatttgggttggttccaagtctttgctatggtgaatagtgctgcaataaacatacgtgtgcatgtgtcttcatagtagcatgatttataatcctttgggtatatacccagtagtggggtggctgggtcaaatggtatttctagttctagatccttgaggaatcgccacactgccttccacaatggttgaactaatttacactcccaccaacagtgtaaaagcgttcctatttctccacatcctctccagcgtctgttgtttcctgactttttaatgatcaccattctaactggcatgagatggtatctcattgtggtttcaatttgcatttctctgatgaccagcaatgatgagcatttttaaatatgtttcagacgctttgtatacaaagcaatctgcttcctgatttaccaaatgtggtaggcggaaaaatgtcccccacaaagatgtctacaatctaaaccccagaccctgtgaatatgttaggtggcattgcaaagggggaaataagattggtggtggagttagggttgcagttagctgaccacaagataggaatgttatttgggattgattctagaggtggggtcaatgtcatcaagagagttcttaaaattgaaagaggaaagcagaagagggaaggcagaaggagctgtgactgtggaagaatgttcagagaactgcaccattgctggctttgaagatggaggaagagggccttgagctaaggaacatgggcatctctagaagctggaaaagcgaggaaacagattctttcctggagcctccagaaaggaaagcagcctagctgatatgttgattttagtctagttcaacccatttgggacttccaatgtacagaattgtaagataataagtttgtgttgttagtagaaatatgttacaacagtaatagaaaactaatacgccagtcatctatgaataagtgaaagaaacacaagagaaacttcttactcagtctgaattgtacattttccccccaaatgatacattcaatgtagagaaaaactagagtaaaagaattcagtattttctttaattatgaatgtttacaagtacatggcacatttatgtacttttaatgtgcagatcacattgatgtttagaattctgcaagacaagctctctataatgtaacataaatgagttaactgccttcttaggaaataggtgctaaccatttccacttgatgggcctcaaaagctgcaaacacattttgccttcaatgaaaatccagtgaagtgttgctgtaaccaagcaacctgaatgcaggaacaagcagccggcatagacagaaagcaatctgtcccttccaacggaggggagtgtgcagtgagtgtagcaaatgctgataaccagcagaactcatgaagacctgggaacatgagccttggctaagcagagtttgatctcattaggaagttctggtaaaacagacacaactaaatgctagttggagaagggagggaggatgttgtagtcatctttatagagaccgctgcagggtgcttttgaaaggcctttcaaacattctgggtagactggttttggttctttagttgaaaacattgaggcaaatgcaggggaaaaaaaagtctttttaggaataatatatcaataaaataattcttaagaaggcacagaagtaagagtaaagacaaaaataaacaatagggaaactaaaatttctgcaaactatattccactttatgtatgaacctgacttttattgtcagctacatgtcttttatatatatatatatatatatgtgtgtattttttttattacactgtaagttctagggtacatgtgcacaaagtgcaggtttgttacatatgtatacatgtgccatgtcggtgtgctgcacccattaactcgtcatttacattaagtatatctcctaatgctatccttccccctgcctcccacccaatagcaggccccagtgtgtgatgttcccttcctgtgtccaagtgttctcattgttcaattcccacctatgagtgagaatatgcagtgtttgtttttttgtccttgcgatagtttgctgagaatgatggtttccagcttcatccatgtccctacaaaggacataaactcatccttttttatggctgcatagtattccatggtgtatatgtaccacattttcttaatccagtctatcattgttggacatttgggttggttccaagtctttgctattgtgagtagtgccgcaataaacatatgtgtgcgtgtgtctttatagcagcatgatttatattcctttgggtatatacccagtaatgggatggctggatcaaatggtctttctagttctagatccctgaggagtcgccacactgtcttccacaatggttgaactagtttacagtcccaccaacagtgtaaaagcgttcctatttctccacgtcgtctccagcacctgttgtttcctgactttttaatgatcaccatactaactggggtgagatgatatctcattgtggttttgatttgcatttctctgatggccattgatgatgatcattttttcatgtgtctgttggtcagccacatgtctttgaagtgttgtctgtctccctcacttgctggtcactccataatccactgcaataacgtgactgtctctgccttcctactgcaaccatccttgttgaggttattagaacatttttgatggcttgagcatgggaactgaaaccattgcgtatttgatcacatgaccctttagagctcttctcactttggactgggcactctttatcctggcgactgctctgccatcttttctttctgaccgtcatctgtgtccatcccagccctctctggtgtacttgcttgcacacgtccatctccagctgggagtctctcaggcgtcttcaactgaacatatccaaaattaaattcaaaatctgtttctccactcctcaatcctcctcttcctaaatcccatatctctgtaactgatgctataatgtgcccagttgggcaagccagaagcagcagcatcaggcggtgccttttatttattgcttgatttataaagtaattagatttgagtgctcattttggccaaggatcagttgaaggaaaaaaaaaagttcccttttttttaaaagaacaacaaaatttctcctggctttatcaatcaccttcaaaaagtagatttagcaatttgttagatgcagtgagtccaggtattcaacttaatggcaggagtcctactcagggaggactctcccttatcggacattctttgcctgaagtttctgctttgtcaagtcctacaagaagtcatgaggataacgacctcttccctactacgtagaagccctaaacaaagctttatttttgctaataatatttcttttttctgcaaatccaaattgttcctagaagcttttggtaatgaaatattaaaaagatgaggagtgcacaagaagcctgtggtaagaaattaagctctaaggaagagaacttggaagcatgtgaaataaaaccacagcaggattatcgtaattgttctccttgacagacctgcccatatgtacggatgttcctgaaaatttgacaagggaattttatgatctatttcaggtgtctgtccatttttttcccttgggagtggagaggatgccgtaatagctcataagggtaacattccccttcataacaccctccttttctcatgccacccacagacctccttgaggctagtctccattcatgctcatgtctcctagccaatctaggaatcctggccatggaccatgataatcttgccactcagctgcatggtagctgagtgacttcaagcacataagaaagcatacagtatcttatgaaaagcataactgttcctcaaacccagcaaccatgtggcttgggcacctcttaccacattagtgttagtgagacatcacaagttagttcagttgaaatattggacatctactcttttgaaaggttcttcttcaacaggccaatattggtgctttggaccagtggctctcaaacttcagtgtgcatgagtgtcacctggagggtcctttccccagagctttggatgcaatagatcttgagtgggacctgagaatttgcatttctaacaagcgttcagatgatagtggtgctgctggtccagagagtacactttgataattaccttaaataaagttctacggggttttctttgcttgtttttgtttatttcacttccccaaaagactgtattaattatggtggctctaggtaatggagtaagacaaatctgaagtcattccaaaacccatagcatacttccttttccaaagaagtgtggactatttgctgttgggaaatgacaggtacctgctcagaagacaagtataataattaaaacaaaaatcattcacattaactctgtctccaataaaagaaggtgaaatcaatgttatagagctcaaagtaggttagacatttccttatgaaggggattctgaagtatataaagctagcttttacccaaaacttgttattcatgagaaactagttggttttcacatatattttgtgatcaaaataagaacttcggtcatattcatgtgtttgtgtagaatgcaacagggtaatctaacacaggagatacagtgaacaaaaacagcgtctattatgaaattaacatcaaagaggtcccgtaagattaaatggagctttagcctctgtatggtctgtgcctgggaaggaaaggggatttttctggaattggcatttctgaacacacagaacaatgccgtctgattgattgctctctatttagaaatagtatttctatcactttggtagaaaccttttatttcatttttgtcctctaacaaagaagtatgatgcttggagaactgtttaaaagggctgcaactctgtgcccatgcttcatcagtctcctaactactttcaaactttgagtggcatgactccctacttccatagactatcacctttttttaatatttttttgttcctagttttgttagaaaaattcttgctagcaatttgttgcacaaatatgactcaagcaagcacattacatagaataatgttgaactaaagtagatttcattaatatgtaatggcacattaggtgctttgtagagcaaaaggactctgtgcttgattttaatacaaataattgcaaaatattaaggcatgtgctttataattttcagtaaatttgtctcataaaaagttatctttcaaaagatggtatgtcactcctctgctcaaagttgtttaatcactctacaatttttcaaaaaaagtttgaatgcttcaaccttgtatattagtcaggtttttgcagagaaaatgaacatatattaaaatacatggaaagaggtttatcatagcaaatggcccatatgattatgaaggctgttaagtcccaagatctgcagttggcaagtgtgagacccaggagagctcatggcatagtttcagtctgagttcaaaggcctgagaaccaatggaaccaaccgtgtagttgtagtctgaatgctggcaggcttcagacccaagaagaattaatgtttcagtttgaatctgaaggcaggaaaaaaaccccaatggccaactagtagaaaggcaatgaggccggaggagttccctcttactctccaggggtcagcctttgtgttcttgttagaccttcaactgattggatgaggctcactcacatcagggagggcagtctgctccgtacccattcaaattttaatctcattcagaaacactcacagacacacccagaataatgtttgaccaaatgtttgagcactctggaccagtcaccttgacacataaaattaaccatcactcctggcatggaaggtctgtattatctagccagaacagatcgggttagttgcaatttctcagataactcttcctttggccattcatagctagttttatttccttaaaaacatcttgatgattcacgtccacatgtttttacagatgtttttccctctgcttgagtgtgattacccttgtctttgtttgagttccccaataagcagatcctgaaacaaggactgaagtagaagtatgttggggcggcgggggtgtggcagggagatgatcccaggaaacaccagtagggaagtggggaagtgagacaagcaagagcagtaggcagtgaggttaagctctaagccagttaccactggacaactggggctcaatcccagtaggagtgaggagactcagggagatagtacagaacatgctttgaattaggccacttgggaagcaagggatctggggtacttatatgcaaattgtccatcatttgagaaaggctcaaccctaaagggtgttaattctctagtattacttgaatgggattcagcaagcagagagagccctcaggcaaagagacccaggagctggtggctcaaaggcaggctggcatgcactgaattgtcaaggaacaaggagttataggcaggacatccacatctaggcatctactgtagcctttctttttccctacataactttaactcactctttaagactcagctgaagtcttgcctcttctggaatgccttcatagaccttctctctgactgagctggctcttgtatatttcccaatacaacttctgtttacctccatcagataatctgttaccttcttctctgttgttttgcttttctatatcgtccactttgtgacctccttgagggaaaagattgctaacctgtatcttcgtaatgggtacacaaggtagagctcaagaaatggttatttgactagcaaaaatagttataaaaatgacattataatgtaatcactcaatgggttattcttgcccactgcacagataaaactaattcagtgagacagcagtattgcagtagagaaagagtttaatgcagggctagccaagcagaggacagaagtttattactcaaatcagtctcccaaaaagcttggaggctacgagttttatggacaacaggcaggggtctagggatagggtgctgctgattggttggggatgaaatcacaggagtgtggaaaactgtcctcatgcactaagtcagcctctggatacgggccacaggaccagttgagtaatgaggcaaaggtcccagtggagtcagtcagttgccagaatgcaaaagtctgaaaaacatctcagaagtccaaccttaggttctagaatagtgaagttatctattagagcaattgtagaggttacatgtcttgggacctctagaacaatggctggttattgtttaaatgtgcctacgtcttagtagaatccaggcttctctcataatcatgaccttggggcctttcgttagttttacaaaggcagcttcagtcctcaaacaaggaagggatagttttgagaagggctattatcattcttgcttttaggttaaactataaactaaattccttccaaagttggcttgggctatacccagaaatgaacaagaacatcttgtgaggttagaagcaagatggagtctgctgtgtcaaatttctttcattgttatactttttctatgtcagatttctctcattgtcacaatttttgcaaaggtagtctcagtaatagcaataatcagtatttattgaatgctcattctgtgtaagcacttgacatataatcctaaccctaagaagttgataattttattatccctatttttcagatgaagaaactgacatataggttatatgttacttggaggccaaaagataacttcccctttgccctctgaaagttcactaaaagtaagctgacaaaaggcaggttaatagcagaaaaatcatacaaaattattttaacatgcataagcatgggagaatcgcatgagaatgattatccactagctaaattgggcacagaagcttatctcttcttcttcataggggagtggacagatggggaaagtagacaattttttgaggagcaataaataattattagggagaatgaatggacccaggagacagaaattaacttgtaaattattctctttggaatttgaatgagcccaagaggcaggcattatcttgtgaaaaacatctgtccaggtgtggttacattctcagctttcttttctgcaatagataatgagatttcaggcagaggatggaagacaattgtgttccttttttggggctactgtttctagatagataagggaactgcagagaaaatcttcaccctgtgctttgggagagacaagggattgagagacggtagtgaggggaaggtccctcatatttcagggtgaaatattctggtattcttcttacccaagatttgcatagttatatgtggtttgtcctggaagtaaaccgaaccagtctgagtccagactctggacagactcttaaccactgtatgactaaatcagtgcgtgaatgaagtgaatgaatgaataataaccccaagcctgatccttccacacatgggagtcattctggggatgacgttatcaggacagtctatgtagttcaaatatcagcttcagtgttatgttctacatacaagaagacttccaagtagcttaactagaagtatcaatccttcctctgacactttttaatagcattgactaccatatgttggaatgtatttgcatgtcttggtttctttactactgacaagattcttaaaaaaaaaaacaaacaaacaaaacaaaaaaaactgcttaagtttctatccatcttggtgttttctacagccccaaacataaagccttgtacacaataggctaaccaatgagtgtttgccaggtgaataacggaaatataagtgacaagcaaagggatctttgactcttcctttatttttccccagaaactgtagagactcttttttatctctctctctgagattccagagagtctgttgtcatacagattttagatggctctgtaaaataaaattatatttaaagatgttaagttcagggaagaatctatgaagtttactttgtaacattttggtaatcatttggttagaaaattatatttctaagaaattggtattcttccttccaaaactgcattcatagaatgaattttaaaaattatgtagaaaatcatcagtgtttctaaaatatttccatggtaaaaaaattacttctttaaaagttaaccatagttatcaagaattgcctttctaaaacctcaaatgaaaggcattttctctttcctctgactaataaatctctaatcatcattaataattaataatcaattcttagaagaggggcagactgagtaaatttggctgggatgactaaattacaaagcacatatataggagaaagttgtaaatcttcactgacttcccattatttacaaagtatcatatagctaatatgtataaaacacatagaaaataatataaatttaattcagtggacatttattgattctagtatataaaatgaatggcattaagtgccaaggaatatacaggaacagaagacctggtctccatctttacagaatttatgatctggagaccgatgtttgaaagagagataaaataacaagtagactgtgtgattttattataataacagctaatatttagcacttaacaatgtttcagtagctgtcctagtgctttacgtggcattatctcatttaaaccttaggaaagctctatgtagtaggcattattattatcccactatacagctgatgaacctgaagctcaggaagatcaaggtaacttctccaagatcacatgcccaggggatggatggatggaggagccaggatgcaaacctaagcccatgtgtatttaaagtccataccaagcaggcagcaaaaataaggtacatcaaagagcacatgattcattcaaacctggggaaatcagaagctatggcacctaagcttgcacttgaaggatgaaggtgaatagagagggagaagggcattgctagcaggaccaaggcaggtagacgaggctgagggagaccttgagagatcagagaagagttaagtgttgccatccatgtgggtggtagcatgcatgtaacagaggaggtgaaactgagaaaagtgtttggaaccaggtatcattggccttgagtgttatcgggaagagtctagacttttctcattaggcagagggcagtcactgaactgttgtgaaccagatcagagctgtattttaagactgatttggcagtcacgtgtaaaaggagtgagatacaggagagagaaaaagagaggagcagttaggaaactgctaaaatagctaaggcaaatggcactgggagtctgaatttgtactgcaataatgtgaggagagaggaccaaacatagaaacaggagaagatttggcgctagctgatattttagtccatttgggctgctgtaacaaaatatcatagactcagtggcttacaaacaaaagaaatttatttctgacagttctggaggctggaagtccaagatcaaggtgctggcagattcggtgtctggtgaggtccctcttcctgtagagagccatcttcttcctgtgtccatgcatggaggaaggggtgagaggtctctcttaggtctcttttataaagacactaatcccatccacagggctcctttcttatgatctaatcaacttccaaaggcctcaccttctaatcaccatcaccttggaggttaagattaagcatatgaattttggggggatacagatattcagaacatagcactggttgtggggagcataaggagagagacgacaatgtgtcagaagttcaaaagagcaagcgtgtcatctatagtgcagaggaatcacatgtccttgtccagttaaaagggattatactgggagatgatgggagctaaatgggagtggtgcaattggtgggacacttgaaagcacatgagtgaaggctgggatttccaaatgcagcaaagcagcactttccatggtgtggtgcggggatttgacatgtgtcggtctatgaccaaataatgatgtccatacttctcagatacttgaagtgagcatgcagacctttaacaaagttagaacatgtggcatttaaagtctgtgatttttaattttgagcaattgaaatgactgaagtgaccatatataatttctataagtaaaacaaacgattgcatatacagttataaatataacaatttttaaaaggaaatgtaaactctaggctttaaattgtgcattaatgtgtatactttcttcttaacttagcatgataataataagacaacagaaatgcatgttttaacagtctgttttctactgatctgttatccctttctttgattttttttaataatccatctggaacattcttgtgtttcccactttcatataagtatttctttatgttttcctattttttaacagacgataataatgaagaagaagaggatgttgaaatgaaagaagattcaggtattaaattcatacttttattattagggggtaggtaggggtcattttgttgtttatgtacacttcatattttttcaacgaaagacaaaataagattaataaaatagaaatatatgctcagtgttataaaattaaaaagtagttgttctaacacttaaggctattgcagttgctgtatttaaggaataaatttgaccttgagtttcctgacagcgaaggtaaaaatggaacatgatgttgtggttaatacagttatataacgaatcacccccaaaacttagagtaagctgaaaacaaccacttcttacgctcatgagcatagcagagataacttaatcatcctgttcacaaggtttggagctcagcaggaagattcaacagctggaagctgggaccatctgaagattcactcacttgtctgtctagtgattgatctcaactgtcagctaaaatcttagctgggacaacttcctaaaacacttgttcatggccacctttatgtggcctgggcttcctcaaagcatggcggccagcttccaaaatgagcttctcctggaaaaagggagacactgtattctcaggcttagacattccattgcatcactccatgtaattcattctttggaatagtcacaagcctgccaaaattcaagaggaaatgaaaatgaactcaatctgttttggggagtggttctatagagcgtgtaagacctaaaatattgctgtggccatctttggaaaatacactttccacatactatattttgctctcattatcagaattgagatgcatgccaactcctcaacaaagcccacttgttatgaggaaaatctagtagttaaatgcacaggttatggcctaaggtagccattcagtgtgtctttgataataaaggcataaatcagtagacctgaattcacttgtagctctatcaattattgaccttaggcaaatgtcattttctataagctgagtttacaattctgggggcaataattcttaccatatagttttctttggaggattaaatcagataacatacctaaagtttcatacagtgcttggaccatagtaaagattcagtaaattattgcttttttctttctcattctaacagatattagaaggatatagagcttaagtctatgattaaaagctccttcttcctcattttggcagtcacagtgttctgaccatgaaagaggtatctcagaggccctgattttgtgttgcttctcatttgatgccagaattccctacaaatcactgacaggctcagtctgggcagctccatcagcagggagctctttaaattctgatgcatttgatctcaatacataaggtttgatcggtgtggtccttctctatgttaagttatatctctctccctccccggactgcccactatcttcaaggggaaataacaccagtttattttcttcataaaagttcattggaacaaggattatagcttctatctactcttctccagtccaaacatgtctgattcctaaggtttccttggacttccaaatgcaatggattcagagggcatgagaagcagaagcagaatctaaaagtcaggagcaggaataaaggaggtagaagaggaactgtagcagtggctgttggtgccctacttatgtctccttggtgcttgctgttattttatagcaccaacagctttccaaagaaagtccttatgactctctgctgagcgctttacttgtcctggcagcaaactcaaagcaccagagaattaatttctctggagcagacctcaaccaataacagacaggaattggttggttaatacccacatctgactcatgttctattctaatgctgtctagtagaaacataatgtgagcctcaaatgtgagcctaatgtataattttagattttctagtagccacattgaacaaagtgaaaggaagaacgtaagactaactttaacaatattttgtataacacaataatccaaaacattatcatttcaatgtataatcaatataaaaatagtcggatattttacattcttcttttttcatactaagactttgaaattggtgtgtgttttacatacacgttccagttcaaactagccacatttcaactacttgttggccatacgtggctagtggctacagtattggacaacactgtttggaggtccccgatagaactgagtcttggttgcccacagtggaatgtgctcatgaacacacccagtattggctgctttccttttcctgtctttcttccctactcctcttgtgatacttactaaaatcatctctcaaattaactgcttaaaactcaaacccttctatgtttacttctgagagaataagacctaagacaaggactttgcttgccttttataaaacatagagctcaaggtaaaatttaaattaaaatttccattcctatacccatgtagaatgtcttattgttaaaaagaaccatatgtttaaaaaagacttgaaattgtcactctgtcttgaattaactttcatgaagttaatcttaatgcttgccattctcatttatcctgctcacatgaaatgtccttggagtatcttttagctatgaggggtactgccctttcaagcacccggtataagggccttatctcgccatggatcatttgcctaagtgctgtaagtacacatttctaagcaaagagagttggcttctcaatgagatttagatagctatccaaaccactgaatgattttaaggaaatcattattaatgctaatgcagagtccccaagtttggagtcagcatttgaggttcagcggcattaattggatcaccatttctgattttagttccaccaggtttcctgggagttttgtcaccagcagctgcatgcagctgttcaagtcatattcaatggcccaaggatgctaagccacttgggcagaatgggcttgggagctactcccaatttcctatacctgagtgctgaaatcatggaggatttttgtgctgaatggttccagctggcctcaccagacattggtgtgcatgctggcttcattcagatctcacacttaagcatgtcagtctcgaagatgagtctaaaccagcctcccaaggcctttaactgctgcctttcccccgccctgcatcaattcttctcattcaaatagaaaagctggagggatttttacaaatgcaaccgacactaatgaagggctacttgagtgaatcaactggccaagacatgctagtgaatgatagtaaataacaacttgaatacctaaacccactggggtgcttgtaaattaactctctgggtaagaagagccccagtgtgaagagtttgcagatttctatggtataaacacaaataccatggtctttttcaagcttccaaagcatgaggtcaatgaataggagagctagggagagatggtacaattagctcgtgtgagctggctcaagtcagccgcagcacagctctgctgagccagactttaattgggcatgtactttgtgccaataacgtgacatgcatgaactcatttaataaacacagcaattctacaaggcaggaactgttattattgaggcttaaaagggattagttccttgcttaaatagcagagccagaatttgaacctgagtttgcctgaccccaaaattcatgtcctttacttttttgctcctgtctccagacttttatagtaagtagaggcaggagcatttcagatggtatcagacatggtcatctgcaaggggaggctctactcccatgggaggtagaagaagcagactggcctaaatgcctagaattccttgtaagtcctttaatcatcttccttaatccttaattccttaatggcaaatgttttcccatgtcctttcatttccatgactatgcactgttgaaattagccccagtctgagccagcagggacagaaaattatcaaccacctatggaaactcaaccacatcacagctggatgcacagttgagtccctcaggggacaaagccatgctcctggcaaatctccaggtttccaccctctgccagacacagggcaagctagaaaacatgatacattgtcaaggagaagcatgggggtgcttttgaagagaagcagaagcaactctcttcttcactccctcaggccaagagggaaagttgttcctcccaagccacaagtagaaacttgggcacagaggccatatgtatctgtgactttcatttgcatgccccaaaacacttcacctgtggtatcatgaaatgatacaatactgtttcacagaacatgtttcatgttcatattcaacatgtaagcatgcccactgacccaaggagtgctctacaactttttcaaaaataaaatattagtactttagggggtgcttagatatttcaaaatgtggcacatggaagtctttttaaatagtacccactccccaggaattcccattctggtggaaaatgaagacctagaaatgtaactcacaaaaatgcaaaaagtgatttggagaaatgctggtttggagttgaattttcagcattggaaactctcttcttgatcccagttgcagacgacacattgcagtgacatagaagggttagatttttctcccagtgaggttgcaaatgtccctttgcccattgtatgaatccctttgagcccagtatttgcactcggtgagctgctccaagcatctcatttctgtttttgctgaacccattccaagggtcaacatccatcttgcacctggtgacagaagtttgggggagttgctaatgtagtcattggcaaaatttttcaccctggctgtggtaataaccttagatgtgactgacttgcaaccacagaaaacctagcctagtgcccaaagctttgcagtttataatgccaaagtttttaatagcacatctatcaaatgtggggtttttttttgttctgttccttttttaataaatgggaaatgagaaatgagtcgccatagctctgtaatgtaattttagaatcctggcacgaaggcgacagctgctaagagagaattaggcagggtccccattatatcttggccttaaagaaagggctggggaagtgaaaataaaatagaatttgaaatgaaattctcaaggcactgctaggcaccagggatacaagagggattaggaaagacaagtgcccttttctcatggaatttatgttcttggggatgaggtgaggaaggagacatacaataaagggatacaccagagagtgagataatttcacatacaagtgatgtgtttgagagagatttcctttctggtgagcctttagattaggcagtcagggaagatcttctagggagttgaatttgatctgagattcaaagggtgagaagggagcagacatatgaatatgtgtgttggaggagtgggggtgagaacagcaggtgcaaaggttctgaggcaggaaccagcctagcagtgattgaggaacacaaagggaaaggaaactgacaaagctagagccaaacacaagagggaggtgaggctagtgtggtaagcggggccccaatgacatgctgtgctaggcctggaattggatttggatcttattctaagcaatggtttttaaacaggtgagcaatgtgatctggtttatgtttcaaaagctcacactggctgctgtgttgaggatagagtgtagagagtaaagagtagaagcagggagattagaaggctagagggttatgagatgctggtctgggctactgtggtgattccaaaggttgaacacagtagatgaatatgaaatctattttagaatggagctgatagggcttatgatagaacttacgattgcttcaactggaaaagtaaatgaagaaaaatattgagaatgacatctcagtttggagtttaaatttctgggtagatagtaataccattccttgagatgtgcaatactgtggaaagaacatgcttataaacatcaagtatatgattctgtctgatttcaaatttgaaatgcctgatgaggtcctttacaaaaaaattgaaagggcctgatgggagttgagtgcaggaaaggaaattattagtgctgtgaagtgtggggcatagttaagtaccagccctgaagggacaatgggaaggaggtggctacgggagccaagaaacttagagggccacatggagaaggccaactctaagatctgtaaccttcgattgagggatacaaccagctcatgaaaaccaccaggtgcctagaaagtaaatgccctgagctccccactggctacatgaaccagggagttcattcatgcaatccagaaaattcagcctcccagagcacagcaggggtggtgaaggtggagagtggatctagaggggcaaacagatatccattcctaaatcccagacaagatgccacgtaggctgttgaagatgtaagtcatgagctcaataggaagaccagggctaaatacataaattaacacctaatgaagtgttctatatccaaatgaaataaactcggagatgctttcctgacactgtcctcagactttaatttatttgcccccaaggatagacttagagggacattgaggaaaataggaagcacagtaatttaactgggacatacagaagttgtttagaatctggattactaaaaacagtttgttaaatagaagcagggtaatttctagccccattcctttctccattcctctagccctgcgttcaggactgagtaagatgaaattgcacaatgacaattgtcaattaatctatgaagattgaaatcgaacactcttggaggaaaaaatattaacagggttcccttatggagaatttctaaatttataaaagcacatgtgtaagattttacatttgtgtgaatcactaatgttatctacaaaaatgttttagcttaagccttaagtttaagtctatgtaggttggagaaccacaagtccttgccagaatttcgctcagccatgatgacagatgaaactgcaattaagattcagcgtgtgtgtaggtttactaagaagaaaacatttttaaatttcacataattttgaaccctactggtaaatatttaaatgagaatattaaatcttcgtgattccagaggggttagagccaaaaggcctctctccaccctacaaaaagagcaaagcaaagaagccagaatgttcgaaagactctagcgagggtaagtcctgtccctccttcctttagaaaattatgccatgaaaagaaacatatttaatttttaaattatgtgtacaaacacactcatgttcagatattcctaagggttaaaatatcacagagaaattcttttatccctttctaatatgtttgaagatgaagaatcagactcaagtttattttgttaaggtaaaacccaaattttaaaagtccattttgtcagtatgttgtattttccatgtctgcaaagcaaaaaattgtaggtagtgcttaccagttacatgttccaaaattgtgcaaaagtgaaggtcaagatttgcatgtgatgaccagctttgcagctattgtcttactggggaaattgtttttctgataaatacattctgagtctttccagattcggacctcaacaacagatgctggaaatggttcctgtctttagcattgtctttcattttctaagatcctacatacctttgcatttttgcattgaatgggcaggtcccactggactcagttttatgaataaatgacacggtctctcttttacacactagtacaacatacaattcattcaaattttcttttgaaatgttgatgagatgttcttttcatgtgaacctcaaacctaagagtagtacaaacttttacacttgatcttagcccaaagacccagaagcgatagagcagtacaaaattttaaagggagcatatttacgctttgtctttcttgcctggatccccacctcctccactgggaaatgaagagtgtaataatactgatggtgtcaggttgggtcttgagggaagaagatgccaagatggaagcagaagtgcaggataaaggtgagagaaatgggcaatggagcaggagcagctgaaaggagagaagaaaagaaggaggctcagctaggaagtgcctcagtctgcagtgcagtctggaagtctggaggagtcctgcactgggcaggaatagctgggctctagggtctcgctttcccatgctcagtcactggctgcaagtagtttggcaagaaagtggccggcctcagcaggaacatgatgccacaggggttctcaacagtgtggttgctgggtgctgtcagcttacttctctcctagcagcaggtctcacttgaaaagaactcttgagctgctcacatgcaggactgcacagtatccctgttgagtgccggggcttccggtgctaagtaatgacgctgctttttcaccttcctgggagttcagaaccaatcgagaagccaaagctgaaagaaaggtggaaatcaaagcattagcttgaatactaacatgatgaggccagagcatctggctgccctgctcctagacaggcttcctaaccctgaatttcagctctaaataggaaagctttaatcactgtcccctcacaggcgagtgcaggtgtcctcagcttcctagaccaagactgccctgatcagcttgttataggatgagcagaccaggaacacgccttctctgtaggcaggtgggtctgagagagacacaagatggaactgtttccttctcccaggcttactgtaagaaaggagaggtgcagaaaggcacagaaacagatgtgacccctcctctacacaaggagcaaaggaggaatatttcctactgacaatgaagagtagaaatagcatgtgtactggcctagcactggcctggccttctgtcagtgatggctgttgttatcaatatgatgatcatggccatcgtagattatgcactgccctaattcagtgaaatgtgcttgaaagtttaaaatcgttcagaggagaacacttagaaccaggaaaaaggccagctgcaataattcacccaagatgttaagctttgttactgcctggttgggagagtagctggggcttccaaatctcctgttgtagttcggtcattttctagaccatctcttaaggccacacttgggtaatgagctggggcaaagcaatactcacctttcccctagagaaactctacctcaccaaatgattcccatcacatccataacctatgtcaaaagttgttttccagaacctgagcctgttgtcatttctgagcctcatataacagctattaagctgtagcagttcttccgcctttaattaaagaagggaattcttccaagttactccttccaatgtgtgaaaacttcatttacttcctaaatcagttgctttgtttaggaacatcattcccgaatcctaatatgactcaataatacagcttcacctcctgtaattatgtggtctaacaatctgctctgaatcataaagatgaaaatgtggtaactggatttgctagcagggacattctgtctgtggtgaaatgtgaatgtgaggcactctccagaaacataggaattgttcatttgttcctaagagggcttcaaagacaaataaaaagtaaagatagctgggcaaggagtgagaaagggagcgccatccggcaggcagcggtggatgattccatgatatgctgttgtgctgaaaccctcccaactttagaggggatgacaccaggttcgagaggctgaagaagagccccagaatcactgaaagagacatggggttttcctgggggctttcatacaggagagagggcctggtggcggcagcctgggcaggaggaccacagccgcttataaaaaacatgcaatggcaacctttacttaccccaagacaaagggcctccatcccttgtacagcctgagttccacaggatgggccgggggctcagatgttccctgtagataaggaatcaatctccgggttgccactcctggattctagttgagaactttgaaccgcattgaggtgcatccaccacatggttcattctcaggatatggttaagtgattgctatcagctgggtttaccacacatacggcacttattacttatcagagtttctattttgacaaaataacctatgtctctgaattcatgcattgtactcttgcatgtgttccatttcctgttatgatacaaagagttacaatcattctttcctagtggatatgcaaatgaaatctggtatcactggaagagggacaaattttaatgctgatcattactctcctctctagatcttcttcccagcttagagttatcaatgtttttttagcttggtcatttcatatttttttagaaagagaagctcctggtatttttatttatagatctctcagcttaatgccccaacacttggccccatctctcttttctccttctttagggttccctggcccacttcccaccctcacaggtactactgatttccaccttttaactgataatgcacattttcagaaagggttgtagaaaacaaactcacctagattttccagcatatatagtcataataactgtatttagattcagaagaaaaatttcaagaacatatggtcaaattttctcattctacagaatttttttaaagtacagactgcaaatgcttctttaacttgcccaagtccacgcagtttgttaatgtcacaatcttttttttttttttctagaaaaaacacagcttctgtaatcttttctctttctctttcctggaaattagaacaaattttttgaaggaagaaatattgtcaacattataaccttgagtgaagcattattactttagtaaatatctcgctaagatactgaacatcaaaattaaaaatcaaacaacttctaaatgtatttatttgcatttttatgctgtgtacttttgaatatagtgattttattatttttagtaaaatttcatgaactgctgtgtactttggtttcacacactcaacaccataccaataatgaaattattagtaatttcaagttactaattgattggctgtcatgtgctataaatgataatgccatctgtgaaccagcaaggcatagacagaattgtttggaaaaaagcctgattagtaccagttgcattaattctaactccccataatttagacctttttttttcttacaaaaagttgaaagaatattattgtagaaaacttagcacctttaataaagcatacttttctcacacttcttcctttgtctttcagaagtaaattatctacaggttcctttagtgaaagtctctcaggccttatttgtctgaaaatggtattattttgcattattttcttaaagcagtattggtgggtaaaaatttgagattgatggttattttcttgcaacattttgaagttttcctgtagttgttaaggaatatttccgtttgttttttgcttcttttaagcttatctgtttttcctttctgtctgttttgacaatctactcattaccttttgtgttccatagtatcactatgatgtgcctaggtatagattcatttttatatatccttcttagaatttgctgtacttcttggatctcggaatgggcatctttcattagttctgaaaaattctcacgtatcactgcaccaaatataacttctaatctattactttctattctttctttctctgttcttcatgacttttaacccatatcgcattttgtcctctgtatctcttctctctctgatgccttccggttaatttttttcaagtctgtcatttaacttgctaattttctattcaactttatttaatctgatgtttaactcttcactgtatttctaatatagttttcttttttgataggttttatttggttccttttcaaatatacatggccattttttatttaattaacacataaaatacctttaataatctgcatcataaatttaatatctctagtctgtacaagtctgattctgcagtttattgattctgcaaacttctgcacttggttatttcctcgtgtattttgcctttttgatgatcatgttccttggatttttacttatggaagcttttttgatgttgctttaagagctcatttatttacacttggttttctaagatacctgaagatattaccttagcaataccttaaagtacatatttggcttagagttttgtttttattttgttggctaatggtccttaaacccatgttagtccatgtataagatgaggaaatctcaacagagacctttttttcccttttttctcacgaccaatgctaaaactgacataggcaaatctcccactatatttatgaccctagcatgggcccctccatgcctcacacgtgtggctcattcaaatccaagctctagctagtggttctcaaagagtgttcttgaatctgcatccatcagcttcacctggaagctcatgcctataatcccagcactttgggagcccgaggcgggtggatcacttgaggtcaggagttccagaccaacctggccaacatggtgaaacccccgtctctactaaaaatacaaaaattagctgggagtggtgacatgtgcctgtaatcccagttactaaggaggctgaggcatcagaattgcttgaacctgggaggcggaggttgcagtgagctgaaatcaagccactgcactccagcctgggccacagagcaagactcagtctaaaaaaaaaaaaaaaaaaaaacaaattctaggttcacgtcccagaccttctgaatcagaaacctgaagtggggtcctgtaatctgtgttctcaaaagctcttcatctgaagatgcacgctcaaacttgagaactgttgttcttgagtctaggttacctggggttggcagatgcctcaaagcaaatactgatttcagtgcctgcttagaactcttgatcctggcactttatcatttcggtttcaagaatttcccttacaaaagcaccagctcagccatgtattcaagaagtagatagatagatgcatacatatatatgtaaatatatatagatagcacatacctactatatatatatatgcacacacacatatagtatgtatatgtgtataccttatatgtatatatgtatacacatacctatatgtgtgtgtgcatatatatatgtgtgtaggtatgtgctatctattgtatgtatgtatatatatgtacacatgtatgtatatacatgcatatatgtgtgtgcacatatatatctgtaggtgtgtgctatctatatgtatgtatatatgtatgtatgcacatacaaatatatgggtgtatatatatctgtaggtatgtgctatgtatatgtatgtatgcatctatttacttatctaatcacacagacatatatgtatatatgtatatgtgtgtatatgtacacacgtgtatatatgtatctttacatacatacagatatatacacatatgtgtgtacatatatacatatatacatatacatgtatatctatacacatacatacatttctaatacatagcctggaaagatacatatcaagttgacctcagaaattatcttggaggagtgaagaaggagcacagttgggttttggagagtttaatattgcactttctaaatttatgtgtaattgaatatgcatacacacatataatgagttattttataaaacaaacacatattttcattaaacaagaactaaatggactatatgttgctaagttcagtagcatgtttcaaacagtaattttctacatacctgagtctccaaagccttcagtggcttttggtaacaaatggcactttccatcatatttttacagaaagcactagcactttgactcttgctccacaattgcctttacatagaatattcagtaggcatacgtgggatgctcattcatcaggaaactgaacccttgcaattctaaatcaagcaaacctatattgcactttaaaatattaatgatgtcttttgtcagatgaaattatatgtggaaacattttggaaactagaaagcactatgccagtttgagggatctaatgataatattaaagttattattattattattttactaaaataaatttttctgaatacatgaaccatttatggaacgtagcttgtatttcccgagaggcagaattttctctctgccccattattttctatgcatattaaagtatcgtgtgacatgctgttttgtgagtggctggacagaagggacattctatctttcagaatgccatgcagcagttcatgcattatattcataagcacgatttttaatttaatttttttgacaagtgcagtgaagggtaaaatcaggcagtcataatttttactttgccatcactcaaatgagcttagtgattgaccagcttttaacaaaataaggatccaggaaaagcagctttcccctgaagaaaagctttgttttatcctctagactttaaaatatcaagaatttaagcaaaatgtgtaaatttccatggtgaaaaatcagaatacaataaatgcctataccaccattttgctttaatcatatttttcttatattctgcttgattccaggccattctgaactatccaccaccacaaagtagtagaaggacccagtggtctattttcatttgtactggtgctccccatgcttacccattaaacagaccacagagtcctgtttcagagtcagctctaggactttaaatgggacttagagaatgtgagtattaaggcattttccattgtgagaagggctgaatctaccaaggcagagaaaccacaggttctgtttgactgggaacgatcccaatttatgcatgttgccattggcatttgttagcaatgttccctttcactcttggaggtaacccaagtttggtgataacatatatggaccctcatacccatagagaaacagttcagtatgagtatggacagaactctcaattgtccatgttctgcttcctacttgggcagtttttctaacctaagactcagtttcttcatacattaaatggacagaagggaaactgatcttgcaggactgcagggcaatttaaataagatgatttatggaaaacaccgggcacattgagtagacagaagagctggtcagtgagtatattgaatttgaaacaagaagagctccctcccaccaaagactcccctaccttgcttattaatgcttgaaattccttttaatgtgaacaaaatacttttgcaagcagagatacatttttaaatgcattgcttgcatcgcacatctagctgggtttgtctctctcctttttcccttaggttcactcagcacactctgcatgcctccccaccccagcccccagttgcactaattccagtcccaaagggactttcttccagtctgtcttcatcttcctgatctctattccccttatcttcaagtccagattcccaagaaactacagaaggtccaccatttacaatggtttgatttaggattttttgacttgatggtgtgaaagcaataggcattcagtagaaatctttggttttgaattttgatgttctcctggactctcgatgtgatagtctttcatgatgctgtgcagtgagccacagcccccagtcagccgcaccatcacgacggtaaacaactgataccgcactctagagtggcctgtgttgtcagcagtttttggatattgttttgtgttttcacatttcatcatgtctacaaaatgcccatctgtgcaagttaggtgtattaaatgcatttttgcttacagtattttcaacctacaatgggtttatcaggacatagccccatcttaagtcaaggagcatcagcagcctatctccaatatttacacaaccacacatctcaaccatttctcaatctctacttaactgtctctaaaactttaaggagggtaccagattaggtcaggggcatgaggaaagaggtggtctctagttatcggccctcagttcagagcttgccactgagacagtcattgtttggtcctcatggtcccttgagatctgttgactctcagctatttctgtaagattctgggaccaagaatctctcttctgaggctgggctattcttactgcctgtagtcttctttccctgataagtgtttctcaaaatatggccaatggaaccctgggggaggtcccccaaagcccttccagcgatccacaaggtcaaaattagttttgcatggagctgtgctcccagaagtctccactcacatggaattcagtgtgcatgaggtcctctatagttgtgcaaaatgatgctactgcagaaacatccactgcatcctccaaccacatcagcatagctgcccaccatccagtttctccaagcactcattccacatacttttgttaatgcctaccatttgacggtgtaggtattgttctaagccctgaacacaatataatatataatatatgtattaatatattataagcccctgctttcttggggcttatattctatatataaaatagaggcctctactctcttggggcttttattctagggtatgtggcattggggattggcagataaaaaatggatacaatgtttaataaattatttatctattgctgcctgaaaatttatcctaaagcttcaaccaacgataagcaattattatctcggagtttctgtcagtcaggaattggacagtagcatatcttgaggttctgggccaccatatctcatgctaatgtgtgacagtttaggtcacaaaagatggcttctaccttgcgccctctcggatcacttgctctggggtaaggcagccgccatgtatgaggaccccagctctgtgaaaaggttctcatggcaaggagctgaggccccctgctggcagccggcgccaagatataagtcatgtgagtgaaccgtcttggagtcagatcctccagtcccaagaaagcccccagatgactgcagacgtagctgacattgtgacaacaacttcatgggagacgtcatgccaagagccatggagaaaaatcaagcaggggaggagctaggaaatgcccaagtgtgtatgagtgtgggagtgagcctgtgtgtgtggtgggggaaattaggagacagctgggttgggttttaaaatatgttagatctctctgattattaagtttctatttgagaagaaacctgaaaagcataaaggggtaagccaggcagctctctgggaaaagagtgttccagtagaggaaacagtaagtgggccgggtgcggtgtctcacgcctgtattccaagccctttgagaggccgaggcgggcagatcactcgaggtcaggagttcgaggctaaaaatacaaatactagccagacgtagtggcgcacgcctgtaattccggctacttcagaggctgaggcaggagaatcgctggaacccgggagacggaggttgcagtgagccgagatcgtggcagagtgagactgtctcaaaaaaagaaacaacaacagcggaaacacaaaatgctaaagccccaatgatcgaggcgtctgacttaccctaataaaaagcaagaaggtccatgtgacagcagcaacagagagtgaaggggaggagagtaactggagaggtcactggaggcctatcctggagaggggtgggttccgcactagagtgtgcatgagaatcaccagagggtgtgtcaaacccagatttcagggtctcacccccaaagtctctgattcagtaggtttgggggtggggctgagaatcttcacgtccaataatcttccaggtgatgccctacgatggagattatatcttgagaatcactgccttgggcattgttggccactgtaagaactttgactgcttctctcagtgaaatgggaagagagcattttaagcagagataggacgtgctctaacttatattttaaaagaaatcttctggttattgtgttgagaatagactgggctaagggaagaaacaggaaagagtttattggagcaagggatactaatggcttgatccaagtagcagcgaaaggcaggaatgataattggtcacttttggacacgttaaaggtaaagccaacagaattcacagacatgttgaatgtggcatgtgagagaaagagaggaggcatagatgggtgttttcattctctccgccactactgaatccagaatagaagttgtaccctggttatgcttaattcaaacattgcaggaaaaacagttcttcactattcatacagtcttcttgtccatcatgtcttcttgctctcctcaccccgggaaggccatagtagcgcaccccgaggccaaagttccttgttttacatttttaatttgtgtttgtttgtttttttagagacagggtctcactatgttgctgaggctggtctcgaacttctgaactcaagcgaccctccagcctcggcctcccaaagtgctgggattacaggcgtgagcaaccgtgcccagcccaaattttccaattaagcaaaagcaaaattttcaggcacaaagaaaaatctcctaaatatcaaaaagagtaaaagcacaaaaatattgacaaacaagataaactgagtaaaaagattattttatgtgatttagatagtatgatttcactatgtttctccccataaaaggtgtttttttattgtttttgtcttgttgcttttcaataagaaacttcccagttaaggaatgatcatgtaattgctgtcatttatgattgccaagctcaagaagacagtaagaaagaaagaaagaggccaggcgcggtggctcacgcctgtaatcccagcactttgggaggccgaggtggccagatcacgaggtcaggagatcgagaccatcctggctaacctgtctctactaaaaattcaaaaaattagccgggcgtggtggctggtgcctgtagtcccagctactcgggaggctgaggcaggagaatgatgtgaagctgggaggcggagcttgcagtgagccacgatcgcagcactgcactccagcctgcgcgaaagagagagactctgtctcaaaaaaaaaaaaaaaaaaaaaaaagaaggaagaaagggaggaaagaggtgggggagagggagaaaaaggaaaatagttgcaagctaatggaaagacccctgaactaggaatcagatccctgaattctattttcatcccttaggtgtacgatcatattctttacctcatgtctctcaggtccatttagatatcaaattctgtaattctacaaaccatcatattcatgaaaattgattctttatgagctcttttcttcatgctcagtaaatatttccatccttaattcaaagcacagaatcatggcttttaatggccaagtgggcctctgagaacatctagggcaacactctcgtttcacagatgaggaaactttcttttaaaactcctctgaaattgtctagaggactcatgaaaggtgatactaagttcactattaaaaaactaaaggaaaagatcagtttatcagggcatagacagtggatctttttatagtaactttaaaggtacctttctttaaatgttatagatgtctgtgagtaatttagactatgtgtttaacaatttgtctattttgatttcctaaaccaaggatgaagaatgcatcagtcagatgtgtttgcctttgttttgttgaaaactcagtccccgggtttatagaactaaagcattagagtgattgttttcaatgttgacaccatgccaataggacatttgaggacttataatattaggtactaatttttcaacagagaaagggtttattttgtcgttaaggagaggtattgctatttgaacagtgttgaattttcatgttacgattttgtagttgtatttcaaaatttcagttttctaatgtaacaaagttgtgctttcctgctataccagagagagccttaaaactgtccacctacactagaatttcctggattcacgccacactctcctaatgccttgctcaagtgtgcctgttctctcctacctcttgtcactctggagccatcagagacagtcttaggaaatgatttcatctccagggatcaccatgcctgaggaatgacatgcagaaacccagggtactgtattctccgtagacagaaaatgctagcagaaccacttgaatcatttctcaattctccatcctgagaattccccactggcttctaacaatctttgctgctggcagaaggaaagtagatatggggtttgagaggaaaggggcagagggaaggggagactggctgtagaatgtggagcgaaagtggaatgtttttgctgagtgcttagtgaacagttgcaaactgccacccttgggagaacctctcattcagccacttatggtgtatccaaaaacgcagattcctgcacctagcccaacccttcaccaaatcagaaagctgcatgctaactagatgcaatgcatctttggagcaccatttcttttgcctttgtttcttattttaaacaatctcaaacttacagcaaatttgcaagtacagtaaaaataacctttttttcctgaaccatttgggaataagttgccaatctactgtttctatccccaaacatttaactgagcattttctacaaattgggcattcatcctgcatgagcacaataaaaagatcaaaattagaacatgaatatggatatatcactactatctaattttcagatctcatttaagtttcaccagttttccaatgatgctccttgtaacaaaaaaaaaaaacgctttcaaactcaaatttctcattttgctgccacatctctttattctcctccagtctggaacagtttcccaatcttaatttgactttactgcccttgacacttttgaagattgcaggtcagttatctactcgaatgtttccaatttggattggtctgatgttttctcatggctggattcaagtgatgcatctttgaagaactatcacagaagtgatactgtgttcttctcatggcaggctatgaagggcccattatctcaatttgtcccattattgacaatattcactcgctttgattacttgattaaggtggtgtctcagaggctcctcaactacacagctgctttttcctctgtttgtaattgatgagtaccccttgtgggaaggcacaatgaaactaggtaaatggcccattcctcattaaactttcaatttattcatttgtgtacttatttatatcctcgtggactcatcatttcccattctattcaatgggttgtaataacgccttagccttggtacccaccaattcttcaaggaggtttggtttcttttagtagagaagcgtatttggaaactagatctgagtattaagtgtgtggatcacaatttgagatatgttatttaaaacagaacgatcagattatcttgatggttcaatgtggggaaccagctcacaagatcagtcaatcacatcttcctgatgaattcatccaattgccagaatggttttcttatagaccttccattatagctgtggccaagagatcaaattgtccaactttggttaagtttggcagagtacagcccaatgaggatggggagagcatggaaatctgtttggtgtttagggtttctaaaagtgttaactcaatcctgttgtcaaattttgcttgtccattatataacaccaaatcaactaattagcaaagggttaatattacatatgtaggcatgcccttgaattgtttatgcacctttttttgttctctttttattgtaagtgttaaaatacacatgagacaaaggtcacatttctacgctgatgacacggtgtgccgtgagtgtggacagtcattttgctaattcttctcattggtggttccgctagatggatgatttccctgaattagccatcataactgccatctgttcctgtgcatagatacagagatctaaagagtagaggtcaggaagaattttaaaaagggctgtgtgctcagttgcctctgtttgtctctctagaacattctctagactgctttttgcctgagacctaaggggctgcattgactggactccctcaccctcaagctttgggttggttaactaatatttctcaattttattttcatgactacactccctaaggaggcttttttagacattctttttctaattgtctccacctgaccatgaaattttaataccataaatatattgcatatctatttatgaactgtatcttttggagggtacagaccattataatagctaagagttttttgctgtgttttttgtttttttcctttttgccctgccaagaacaaatgtttgcttcccattgagaaggcatgcgctagaccagtggaagtcatttaagggagattggagaatggggggaaaagtactaaggacaaaaagacatttattctctttgacccttgctgccagacagaaatgacttcacccaaggacacagcacttgcgggtggccttctccacctccagctattgcttggtttcaggtgaccactccctttctcttctcaggcctatgggtggtaacagctcccatccactgctagtcttagacatctttactttccttgattgattcccttgactctgcccacatcttttaaaatatcccatattaaactttttacacccctttgaatgtgtcctgcttcctgctgggaccatgactagtctcttctagttggaatccatatcaccttctgtgatgtagtctccaagtcaggcagtctcatttcaactacagtctttctttatgcttctctttttcctttctggactcttacctttcttttatttcttactcagcaacagtgtctgcccattaaaatgcacctttgcggtggtggtttggttttctttatctctcttatttcttcccttcctgttgcattttcactggcattgcatgggatttttgtttggatactaagccaagcatcttatacccttgcatgcttgacatttctcttgcttagctttccaaacacccaagtcaccctgacaggctcttgaatactttcttcccacaagttagtgatcttagctggcaagagcagacaatggcttgttccaggtactagggatgtataaaacttgttggcttaaaataatgacatttattttgctcacacatctgcaagcttggcagggctcgacagggatagttgtctctgctctactcagcattggctggggtggctcagaaattgggaggctgaaatatccagggcttctcttactcacttgtctgagccctaagcttagaagactcaaacaactgaaagctggaagaactggagctctttgggcatctctctagcttgatgaagtctctccatgtaatctaccagcatggggggcttagggcagtcttacttgttacacattgacccagagctcccatagtgattatgtcaagagaaagagcttgttattcagtgttatttttaccacattctattggttgaggttaacaagtccccaggattaaggggagagaacttagaccctgccttttgaaggagaatgtcaatgtcacattgtatatttttaaaaagtggaatgagatatgtataggtacagtcatttttggaaaaacaatctgatctgcttcagtatcatacacataagtacataatacaatttttttttttttttttttttttttttgagacggagtctctctctgtcgcccaggctggagtgcagtggcgggatctcggctcactgcaagctccgcctcccgggttcacaccattctcctgcctcagcctcccaagtagctgggactacaggcgcccgccactgcgcccggctaattttttgtatttttagtagagacggggtttcaccgttttagccgggatggtctcgatctcctgacctcgtgatccgcccgcctcagcctcccaaagtgctgggattataggcgtgagccaccgcgcccggccgtaatacaatttttgagaccttgtggaagtcctttggggttcagaagaaaatactggaaattactaatggaaaacaagcagagataggaagatgtcagtaaggaggtcttaatacctactttgtataataatggggctcaggatttctgagtgagaagatcaagagtaggtacagtcaaggaaataagaactctggattcctgtctatgcagattgagtcaagcaagtctctgatctctatcaaatgaagaattaatcttatgattttgatgttctttctcaaaacccctggttctgttacgccatcatcaactcacttttctgtttcctgtttaaagtcactttctctcaaaatttgctgactccaaattctgttgcttttgctgagaagacagtcacactgctgtctatgcagctccactaaatcaagtgtgagcttcaagtcctcagtggcaccaagcgttatttcaagagttattcttcctttgtgtatgaaaatttgcattttgaatgtgtgtcatcagagaagtaatgggaaattggggattgtgatgtggccaagtcagaggacatgtgtgtgtgtgtgtgtgtgtgtgtgtgtgtgtgtgtaactatcaccattctttttctctaaaagagagttttgatggtagatgaggacgtaggaccactagattcaaaagtggaggatgtaaaagaatttggaaatagattaaacacaattctggagttgtctatgaagctctctttataaagtatcttcatatgcaacagcacatgtagtaggcactttctgacgatggtcacaacagaacgcagaatggctgaagccctgaaatgatgcacactgtatatgaaattgaacacgtcggtccacgaatgtttttaaatctgtaatttaaaaaactcccaaggtgtcgccaatgtgaaaataagtgagaaccacaagcaacctaccacatggtttgtagaggccaagattctctcagattcaaggatagaaaagccactcaaaactgttttaagcaaacttgtatctgaaaagtctatttgatacttaattagctaatttaccagttgcatcagaactaggttcctctacccatctctgtgctctgcctccctctgtattggctctatttcatattctcacctctctgggacaaagatgaccactaactgctctctcatcaaccctggtataagtggcatacttctttctcaatagctcccatgaaagatctgaaattgtttcattgtctccgattggctagactctgatctagcatctgcccttgaaccaatcactgtggccatggacatgtactgccctgactaggtctaggacacatggcaactctgggaccgggaggtgcaggggtggagcaacatggttaactataattaaaactatggaccaagtaggagctgagtggttccccagaggaaaacaggggaagtatcaacagggaaaatagacggtatgccttctattctagttcgtcgtcagtaaatattatttgatcattgaattcttgtgtcttgttctttaaagacagacaataagagttaggaggacataatgtcatggctaacaatgttgctgtaaattcgttatcaatttttccctttccactctcactttattataaaagatcaaaggggattttcaggaaagcgttaacactacttaaaagccccacctcgaagactggaggtgtggagagaagctatatataaggtggacccagccaggataaatgtgaaggataggcaagaagcactggtaggtgaaggtgaatagtgcaagggtatggactgaaaatcagtgtggtgggagaagtgagaaaacaccaggggaggaaataaaagctaaacaaaagagagagtgccacctctgtatgttgttgctgggattatccataggaaacagacatgtggaaaaggatcctgtgactaagaatagggcgtacaggaagtaaatagtactgttagcctctggaaagcaatgtggaattcaacttttaaaatttgcatgttgggcgtgttggcatgtgcgtgtaatcctggctactcaggaggctgaggcaggagaatcgcttgaaccccggaggcagaggttgcagtgagccgagatcgtgccattgcactccagcccgggcaacaagaacaaaactccgactcaaaaaacaaaaaacaaaacaacaacaaaaataattgcatgtttgctttttaaaacattgttctgtgtttccaagctgttttgacagtgggtcaaaggaatgccaatagtacggattatgactggcttcattttaaatggcagccccaagcaaagttgaaatttgaacttctgtttacatttagaaattctctggattgtctggtaaccttgtctttagaagcctgatgtttatatattggcagccacagggaattatttccctttgggtgttcaattgctgtccaatttccttatctactgcccattaaattaggaaacgttgggtctcatcatctgcttcactttccaatcactttaccagcaataggcttcaataactagtgccttgcagtgttgttttgtaagccatggtgtcctcaggatgcattttaaaaaatagatacctgaagtaatgtgaagagccagtttataggtttaaaacctgattttgagattcagacatagttcttaggaggctgaaccctgaggtttttcttttcaacttactcactatacagtgtgttgtatttccaaatatgaatcttggtaaggacaggtttgaaacagtctagcttcattgaccacaaaagttggttatcggtgaaacatgatgaaaacatcacatttctcatttaccaaaaggtgccttcagtggaggttattggattgcaaagaggatgtttgttggaaccgagaataaaaaccaaataaggttataaaacaaaaggtagtgatgatttgacattgaatggtatgcccagaaacttaattaaattttaattaaaatgtaattctgcataaaatttaattatatgacaatgagtattctcatagagtaagttaggaaagttttctaaagtcagttggaaaggcaccatgcagtgtgtcataataaaaaggacagaggctacaaggccagccagatctgggtttgaatcccagctctaccactgactggttctaagcttcagttttctcatctgtaaaatgggaataaattcttactctgcttacttggcaaaaattagaagtcaaatgtattattaaaaaaaccattcataatgtttgacatttaaaaatatattaggcattcaaaaatggtagctattatcactattattattattatttcttctggagaatagatatccattgtccctcttctcttcatagaaaaaaaaaatccagaaaacaaatgcctttttaaataacctggttgtagaattcaaactggctctgtccaacaaaattatgtttaaggctggagagagttttgctagtttcccagaaaaagtattgtcaaattacttttttcttgttgtgtgtattttttccctaaattctttttttataacttttactttcatctgtgtggaaatattcttggccatctctctgttgctatcccttcagtaagtctgcaattattttttcaagaggtgccagcccaaagaatcataagcccttatgagctaacagtgaagtctcagccaagaaaagaaatttaaaaaaccagtttcctgaaaattgtaacatacataagtttggaatgtgcttgtttgtttgtgtctttcttttttagtttatagaatgctttgctctttatgttgaaaaactgtccattattactggctgttggccattttttcatctctagggtaatatatttctactataaaatttcaactctggtcaaagcagacagtgtgttataaaaaaatatactgagcacaaatgcagtcgtaaagtctcatatttatttacctctcaaagtgaaagtgcttatagtattttagggacacagcattttttaaatactaggcactcagtaaatatttgtgggtggccaagtgaatgaataaacgaataagcaaatgaacgatgggaatttaccatgactgcaaatcatttctcctaagtgaaatatactgtttgttttcctgtgtgtgcatggagggggcagtgaaattgagataaatctcattgtttaaagagttctttagggactaccagagtagtggacatggtaataaaacattgttctccaaagcagaatatggtagttacagttacaggaagactattaacccctttctttttctagaatggctgccctgtatgtaatttaggttttgaaatcttccttttcctggacagagaatcggtcccagaatatcagacctgtgtttattggaaaacagctctatctatcgcagagcaatttctgttgtccttattaacaaagatctttgggaggtgaaggtcatttcaggccagtgctgaacagcaatgaatttgttaagttgttttccgaatgctgaaaggagatggacgtcagaacctggacatgaacctaaggcagttgggccaggtttaaacctcgcatgatcagtgggaatttgtgtactttatttaatgggaagcctcaattgccttatataaaaagtgaggcaagtgtagcatacacctttcagtatttggggtgaggattacatgagataacacgtggaaagcatttaccataatgcgtaaggactaccactactatgatctgtttctactcataatacttctaacatcaaatatgtgttttttccctcacactaagcaattctctagttctccagacaccaattagttgttctacaatttaagtcaagccttacactatctagagtgagcatcaggtggcacagattaaggactcagtcccacaagactccccccacttcaagatacccatggcaagtccaggcaacctgtacttctgacagacaagctacaaagtcataaagttgaggggttcccatgactctttcttgggtttgataatttgctggaatgggtcacagagctcagggaaaacaatttacttactgctaccagttaattacaaaggatgttggaaaggttgtaaatgaacagccagatgaagcagtgcatagggtgagatctggaagggtcccaagcgcgggagcttctgtccctatggagttggggtgtgccaccgtcctagcatgtcagtgcattcatcaacatggcagttctcctactcctgttgtttaggttttctatggaggttccgtgacattggcatgattgatgaaatcattggccagtgatgactgactcaatccccagcacttctctcctctccataggtcaggaaatggggccaaaagctctagctctgtagtcgcaaggttgggtgccctggcaattagccccaccctgaagctatcgaggggcccaccaagaaccaccttattattaggcttaaactcaggtacgattacaagtgacttatgaaacaaaagatgctcttatcactcaggaaattacaagagttttagaagctctgtgccaggtactaggatgaagactaaatatatatttcttatttatatcacagtatcacactaaagcataggaagttctcaataaatggaaaataaatagtggtcaaacccacctttacatattttgatgccaagtgtcaagaaggattatttatgaaactcttctcacacaagtttccatttcttcctttgtacacatgagagggcctgatcaggtcagaagaaatcacatttcacacccatggttttttgagccaaaggcacaggggtgtgggggtgtagggaggcaggttgggatgcttcctgctggcagtggtgtctcaaagagcacaaggcagggaaaataggggatgggtggaagaggatagctagggtagaagcaaaggaaaataagtacagaggggaggcagagagaaagggagaagggagagtgccatggtgaagagtttgacttgccagagctaattctttgtaggcaatattagggtttcttggaaggaaatcccccgttatggacttggaaggtaaaaatcagtttccataaaagagggagtattagatacactaagctggatcatgaagaggtaaaatgtatgaagattaaaaagaggatgcagaaaagaaaaggacaaaaatatattaaaaattagttcaactcctgctgggttcttcacgctcacagctgattagaaggtgggatatatctgtgtaacatatttgtggagcctgcttagctggaagtcctcatataccccctaccccaccacccaccttcccacacacaccctacttttggggagcctggctctgggctttttctcactgattcttggccagagacagcactcccttgccatgggggctctctatagaggatgcgtgtcctcatgagatggcagctggcttccctgagagcaaggcacgggggagagggagagcatgtcctggcttgaagtggcagtcattttatagcctaatctcaaaaaggacatagcatcactttggctgtgttctgttcattagaactgagtccctaaaccctgcatacacgcaagaggaggagacttaaaacccatctcttgaagggaggaatctctatgaatttgtgggcatatttttaaaaccaccatcatcccaaacagcattctctttagtttcttgttccaagacttcctgcatcccgactatgtctctgtctctgcttttggattatttgagatctctttaaatattaaattccatttactgacttaagttcgaaagtcctttccaataccatctgaagtcttggaatcagtgaaaacatgtcagacacgggcactttgctgtcttgcagaaagtaatgactttggtggacaagaggcagttggaggttatcttaacagaggatcaagccaattcctacactacaagggtaatcactccgcaatgagttcaggtatgcggtttcctaggctgagtcatctcctgctatttcgtcaggtctccccaaaacaggggtcagtacacttctgtaaaggaccagatgggaaatatttttggctttgtgggccacatgtggcctctgccacatattttcttcatttttattacaaccctttgaacatataaaaaccattcttagctggcaggctgtaccgagacaagcctccaggatgtagtttgcagacccctgcgctaaaataatcatagagaggtgcttgtcgtgtccttggaaatattttagatatgcttttccataccacccagccatggtaagagtcttctttctgtgtctctcaaatttcctaaaagatccaatttatcttacttcagacaaagagctgggagtccttttatcaggttggatacattttacataggatttctctcattccttcagggagacagaaacaggttcaaaaattaagtcactaaaatgactaatgtggtactgtcagagaagaattatgaacctgcagggttatggtctcagaaaattcatattgcgtttctatgcctcacgtgaataacaataaccttctccaacaagcagagtgaaaaatgtgaggactgccagtaagtattccttactgctggctaaatgctggcaccacacaggctttctatggcaatgggaatttgtgtcagagttggcttttaatgtggaaaataatccagtttcatactttggcttttatgtctttgctgttttctagaacgtcagcatgcctcgtgaatgacattgaacactccacaaaccaaaccaaaacaaaagccttttctgtgtgtctttatcagcaagtgaaatcaaaattgttggatgagaattctcaaaaccaaaaaaatctacgttttatttttaccagggcattagtaagaaatgtattacttagcccatgagttgacaaaagaaaatgtattaacatgtatgtgtgattaatgaattcatactaaaagagggaaaaaaggaaaaaaaaaaaagctgaaggaagaaactaaaagctgttcatcatattaatgttttgtagccccagataagtagtgctgctttcttattttactcccatgcccaaacctgtagtactgcaaaattgctgactcgaggtcctacatgaaaactgtgcagagacttgaaaactcttgcaagagtggggagttctatgaataaataaattgtttaaagggtcaatgaatcaggtataaacctcgttttgtaatcataaaatctgtggtctcaagtctgtttaacgctcttaaggtttacctcataggactcactattagttgtaattaaaactgaccaaaaaatcataatttaattggcgttaataggacagactttgaagggtcatattttattttggatacataatgtttcttcctgaaattatttattcttgtaaattattctgatttaaaatttattagccagttgttgaagaaattatttacttgccatttatttgaatggttcaagtagtatatgcgtatatttaagtatttatcctaacattttcatgtgatcgggaaaacttttgctctaacttgacatgttttaattggcgttttatgtcacaagacagcatttgttacaataccattatttgggggttttcataagaaaacctattacagcctaaatgttaaaaactaagatcatttagacacttctagaagcaaaaatcttctgggttccataaaacagggaaattgggtttatcaagtccaagatcatctgacattagtaatgagatatgggagaactagaataatttattcttataagcaaactgctgagaagatagaaagacctgaaaacctttctcaagctgttgctgtaagattgttctcctgcagtctgccttacgggtagtgtgctctatcatccctccaccatcggactgtttctgtctactgctgcctgctacatccactgcctcctcatggggctccacctgtttagggaggaaggggctctgcatattaaatgactgatcctagaaccaatgaggggctctgcatgttaaataactgaccccagaaacaatgaggtgctctgcatattaaatgactgaccctggaaccaatgagagggatgaggcattagacagaccgattctcattttcaatgagtgcagtcacttgcagagatctctcttttcatagatcacaaggctgcctgatatattttttaccaaacatatttctgtggagaaaaggcagctggaattcctttacatttatccaaaaaaaagaacatttgataagggcaaacttctgcaaattgaccgatttggcagaaagaacaaagaacatgctagaatactccttagtgagggattcatgtgtcgttttatgtctgtaccattgtacatactggcaatgcataattgtctgtggcctactctgccaccaggagagaggaaacagatgttcctatctgtcttttgatgtggcttctgatacttacattgatttgtctaaaatagcatcagctaccctagaaaatttttttcctagtccttgagttggttggctaattgtttcaggtgactattaataatgtgggccaggcacggtggctcatgcctgtaatcccagccctttgggaggccgaggtgggcagatcatgaggtcaggagttccagatcagtctggccaacatagtgaaaccctgtttctactaaaaatacaagaaattagcgggtgtggtggtgtgtgcctgtaatcccagctactcgggaggccgaggcaggagaattgcatgaacctgggagacggaggttgcagtgagctgagatcgcgccactggactccagccaggatgacagtacgagactccatttgaaaaagaagaagggaaaaaaaaggaatgtgattatcatctcaagacgatccactgtcagcgggtattgccctgttacagggaaaagacagagaccattgggaagtggacttacagaaaaaaaaaatcacacagtattttatttattcaaagtggagtaagaccccagtaagactttttggaatagatctaatgaaaaattgagggtaaatttaaattcaacatcaggaggtcttagcactccctgctccatacagtaattatagaactgtggttataggtaggaagactagataattagagtgttatcagtagtcatgggagaagtgacaggttcattactaaataaaagtaatttaccctaaattgaaaatgacagctgatgccttctaaaagcacagcttgattagaaagaaaccatgaggatattggatatatgtaggagaagaaggaatggcaatagatctgaaatcacaaaatatatgcagaaaggagatgacgggggttagagttctccttttgcttaggctggtcccgagggcccacaataggctatattcttatttatgacataaggagaacagatattggaagcaactgtctcagaccatcagtcaaaatgtacaacgcagacaagatcacgaaaggaaaaaataagctaacagggggtatcaggaagtagcataactatattaaaattgactgttatatgcacattttacttaagaaaatcttatacaaaatttctagaagttattctagagggatttctactgggctaattttttttctcttcatctatttgacctcattttttattaaaagacctctgttgcatttctcatggtcactgtaagccagaatgtcccccttgttcccagactccacaacatgcagtttttccaggctgtcagctagggtggaatgcagggtggcatcaaagcgtggtgactgacagcttgcctttagccggcaaatgatgaaggctcaaatcgtaattctgctccctgctagctatgggtgctttggagaattgcagagactagaacaacatttctccacctaaaaaatagaatattcattatatctgtattattaagttgttaagaatgttcttcaggataattcagagcttttgcagtagaggtcgacaccattcctcattcttcgcacctccgtccaaccactcaccaaagccagttggttcaatctcttgaatctcttttcagtccatcctgttctctccctcctcacctgctgcccctttatctcaggcttctgctatctcttgtggagtatttcaatcaatttcaagtgggtctttcatgctattacatattcctaccccacaaaacagccaggtgagagagaacccacccatggctcccagctgcccccgtagacatgcctcactcccagcaaagggcacaaagccctttctaatgtgaccacggtcttcacctggcttcaatccttccccactccattcgttgtctgctccagccgtactaaattactgtgactccccaaatgtacatgcttcctctcacctctggggcttgctccccacccagtgaaacattccctctttcctcaactcatcctacttcatttgcgtgaatatttcccacttagatccatcgtgaagcaccggccatcggcactcccgccccataggcccctcgtaagtctttgaagatgccaaagcctttctcacataagagttcctggacgtgctcttcactccacctggagcgatcatccctctctctccttttaccccattcattcctactgattaattttgcttcacaagtgccttaggcttatcagctcaaatgccacttctacagggaagccctctccaatactcttgtttgttagaagccatcttagccacctacaacctacatttcccttcgttagcacgtatcatgactgaggatactatatttgcgtaattatttggtttaaaaatctctgagagcagatccctccaagcacatgctaagacaaagattcaagggccagcagttgatctggggagtgattcccaggaagggccagtagagaagcggtgaagtgagatagagaaggggaggaaacaaaaacaggtgcatgaacaagtagattgtcctgtgggcagctgagacttagtcctgcgggaggactccgggaaatagtgtggatgtgcctctgaggagtcccactccaggggcatggatgccagggtaggggtatttgttcgccccctcctgtccgtcattggttgagggctgcttctgggatattaactccccagcacctcagtattggcaggacaagcatcctgttgagaccagaaaaagccctcaggccgcatattcaagagaagaagcctctggtgcatgcagaaatcagaggtaagtgccagggacgatggccagggctttgacagctgtggctacaatatccatctgtcccactggactcagctccacagctcttttccccactagttatctctagagcagcactgttcaacagaaatatagcatgagttacaaatgcatatgttgttttacatttttcagaagccacatttataaaaaaggtgatattaattttaacactatattttacttaacccaatagatcaaagtagtatcatttcaacatacaaccaatatgaaaatcgttccttagatattttacattttttcacactacattcaaaatctgacatatatgtaacatttatagcacatctcaatgtggacttgcctcgtagtccgtggagtgcccatagccatgtgtggctagtggctatcacagtgggcaatacagctttaaaggacagagtctgggagagactgagacctcaaaaaatactcagtgacaaaagtctccgctggggcagtgcctcccctgagcaaatttcactgactgcctccaggactggaattaggtgcttaagagcacctgctgccctccctgcttcctccagcacaatgttagctgtacctaactgggtcttgtattcactcatctgtctccccagcatgcttctggagggggtgggcccccaacttgttcattcctgtgtctgcagcacctggtgcaatgtccagaacagagggagcttccccaaagttttgctcaatgatgaatccattttaagataaggtgattacattatcatctttagtgaaattttagtgaaaaggtaaattctatacattgattttatgaaaagtctatttttgtctacaaatattagtatagccatgagggattattcaactcatggctacagagattcagaatttggacaatgaacaatgcagtaataaagtgggcgttcatagccacatgtaattaacaaaaataaatcgcagcatactttctacttttacctgttaatactctagagcctagaccaattgtattagtctgttttcacgctgctgataaaaacatacccgaaactgggaacaaaaaaaggtttaatttgacttacagtttcacatggctggggaggcctcagactcatggcgggaagtgaaagactcttcttccatggcggtggcaagagaaaatgaggaagaagcaaaagcagaaacccctgataaacccatcagatctcatgagacttattcactatcatgagaatagcacaagaaagaccggcccccatgattcaattacctccctgggtccctcccacaacacatgggaattctgggagatacaattcaagttgagatttaggtggaggcacagccaaaccatatcaccaatcattctcaaagagtgtggccacactcatagcagcagcatcacccaggaattgattggaattgcagtgctcaggccctgtcccatctccgctgaaccagaacccagctatttgtgttttaacaagcccttcaagggcctctaatgcacagtgaagtttgaggaccagtactccagatagagtaatttccaagttactcctttagaaggaaagcaggagatcttagacaagagcttcctgtgcctaaaattccacacaaacaaaacatttggtttatctgcctaaaggtgtgtggtttctctacttgcaaattaatttcatatgaagtaaagagaatatgttgagatttattctggtacaatgtcaaatagcgattagcaaaacatttggctaaacaaagccattattggaaatctgtaatttttaaagagagattaaatacacatagaccaccctcttgtttttatacttgtcagtcagctttggggtggttgttgagttttatcatctatgggatcatactgagggcaagagcacatttttggaaaaagttcatacaaaatcatgggaaacccatatattgctttcatcctgaacttcaaaattccaaatcaacatctttaaagttttattcctactacttgaaatagcatgtctcaacacggaagaaacaagtattttaaaggaagaaagtggtagaaacacagaattggtttttgcttcccatgataatatggggctgcccacaacctcagatatatgtgtattgaattataccttggagagaaaataaattaggctattcagaaagcaggagactttccctttgtgagttgccccagacagacacttgcactcacacatctacatcttcaatcgttgacttcccaaagagccatttggacaatgccaagtggagaactgaagcagttactcctttcatccagcaaaaatacccaacatttattcatatctacatagaggaaacaacttttttttatttttctctggatgatcatctctagcctcagtttcactttgtgcaggcagacacatctcatgaaacctttccattcctctcccttctgtcaactcctaaagggaaaggcttttgtcttctgaatagcctaatttattctctctccagcatcttgaacgttgtaggtactcaacaaacattaattgatgacaaagctatataacagcttttgaatttattcatgggatgattcttctatttaaagaacatctttatatactttccattcttcagcaaaaaaaaagcaaagaaaaaaaatgtttcatcttgccagttctgtatttaacatctgcacagagcacagtgtgtgcctgttttaaacaaatgtgtaggctcactggttatctagattcaggaatgtaaaggacaatacagagaaatgtaatttttagaagaaaatttaaacttagggcttaatgaaaaaaatgcagttgctgttttatcagagagagtgagaaagggagagaacaaggaaatcccattgtaatgctattatgctaacctcattttggccatgattttcccagttatagagtggacaccaggttatgtgcatatctgagaactggcataatttatcatcaatttgcgagcacagaacaactagtagaataactgtgtcagtataagttgatttctaacctcagttgtaccatgaagtcattggaagactttgggaaagttacttaattctcatttgttagttacttttaaaaaacagccacatgaatatatttcttattattgtcattccttaatagttattgattgtgtacaggatgctttgtatctctgcaaggcactgcaacttccccagggaagcccacattaatgaatagtgtttataaagtacttggaaatccttggattaaaaactaacggtatcaaagtatttgtattaacatgccatatgggagaaccgtatgttatttattaagaggctatgtgtggtattgaaaatagctctctggtgcatcactttgtgctatttttatatcaagatatgccacggcaagttttggtacgcttgggtcataccttcaatgttgaaatgcctcaaaattcaatccttccacaggtatttgttgagctccttattgagcacttgactctctgcttaccattacacaacacatatggaaggcccagtggcacctacagtttcatgcatttcgtctctttgaacacgtgttattaaactgaagtccccgttaacagacacacgggcttaaaaaattacaggttccatttttcctcttccttctacatggacaatgctgttttgagacacaatgatagagatagggctgacacgattgtcttgtctgtcctaatggttgaagactaacccatgaagcttgcaccccttctgttaatggggcatggatgcagcactatttgagtttattttgggtagaactggcagccaggagagcactgcccagcatttccccaaactggctacacatgctgcaccaccttcccagaaggctgtaagtcattagtctggagaactatattgtaacgagttccatacaaaatctgcccccgcctggggaggcaattccttctcttagctagttgctctaataaggagacgatggcaatgggtgtattatcacaaggtcctgagatcttatgtcggggccagcatccttgaaaaattctgttctaaatgacatgtggaacctcatgcttcataagtaactgaaagatcctggaatagaagataatctacctctttttttcctgattcatttgtgaactatccagacaaggccaggtaaggcaagagcgtatttcattaactggagaatatttattgaacccctaccaggtacttaggaaacattgtttcacaaagcagacaaagacccttgcctccgtggagcttacattcaaggaggggcaggaacacataaacaatgaacatgatacctacctaaattagaggatatgatatattagaagatgatggacaattgaagaaccaaagagaaaaagttgatcaggataagaaggatggagtgtgtgagggtggggagatgatgcaattttaaatggaaggttcagtacagatctcattgaaaggggacatttaagcagtaacttgaaggagctggagagaaagcactccaggtggaggggtcaggcaatgcaaaggcctggggagaggagactccaatgtgctggaggaacagcacagaggccagcatggctgcagcgactgaaccagcaggataccaggagagaatgaatgaagacagagaaacaacgagggtctccaccacgcagggtcttgctgccatcagagcattcaagcaggggagtggtatgagctgcctcacactttaaaacaaaccagctagtaggctgagaagaggtgttgagaacaagaactgaagcagcaaaacacatcaggaagccattgccaccacccaggatagaggggatggaggatggccccagccggcactaaccattaactaactattaatacttgtgctccccacacttcaccatttgatttttgggaaccattagttgagatcaaagacacatgaaatgtttaaacaaatccacaatttaatgaagttcaagcagaagctgagatagatatcatacttcatctgcctagagaactgaaatacgattcaaggaaaaaataataatgctttgggggaaaatgaaatttccctcctaatcccttgacatgtgtttatggagcccttaacagataaggcactgtgctgggtgccaaggacaccacagaaaaaagagacatctctctgcagagggcttatggcttagctcttgcaggtgagcagaggtctcaggaatctgcaaggcaagaaagagagactccaggatttggcatgatctggacctgtgtttaagtctcagctctgccacgaactgtgtgacttcagggaagtgactttgatctcccacagccttgatttcttcatctgcaaaaatggagataaagtcgaatacgacggtatgacgttcatggttatgtgtgtgaggtgtgtgagcgtgtaaaggcctggtgcaaaggagacatctgtaggaagcggcagctatgactcctgctaggtggagactattcactgcacacctttttatctgcactaaaagatgcacatgaggctcttcattaaaacaatgaggcagccaacatggaaacttttctaagagtaagctattaaaatagatcaatcagctaatgacacctccagacaaaatttgtaaaggtttggaactaacattccctccctcctttccttccttctttcctttcttcctaaagccattaagcaggactgagaaaaataggtgtttgcattggagagaggatggtgctgaggggtcacagggtttggacagagtcggaagggcttctctgtcccagactactgtgaactaaagagacacaacaactgaatgctgtatgatcctagattgctattaggttattcttgaaaagtggcgaaacacagatgtgatctgtagcttagatagcaggaatgtcatctatgttaatcttttgatctggatggttgtattgtggttatgaaaaagaatgtccttgtttgtagaagatatatactaaagtattcaaggctgatgggcatgattaggacatgattatgtctgcaacttactctcaaatggttcaggaaaaaaaagttcttgtcctgttcttgcaacattctgttgcttaaaattattccagaataaaaatacctttagcaataaacacaaaactttagagttgtagcactgcactcacttgatatgagtgccagaggggtttgattctcaatatttgttgtgttcaatgttaattgagttaatccagatgagattatcatttcccacatttttgctgattcataatttacatatcttacccagacaataaatagttacatttctaagtaggcagtagtaggccccaacatcagctaaggctgggttgaaactgtcccctgctgccatcacttgctagctgtggaatcttaacacgcctgtgtctcagttgtctcatccatgaaatgcagataataaaacctgcctcatgcagtttttatgagaatgaagtttgataacctttgcaaagcatttagacactgagtggaacatatgcaatattcaataagtgttagctggtattagctaatattctgttgctcatagagctctatagttaaataaaccataaacatcattatattgatggcagtgcagactctttaagagcattcctctgttatatcagctaattttacttttcaaatatgtaccttctagagaattttggaacatatgagatgaaaatatagatggggaaatacaaaattaaagactagatttttttataaaagagtgctaattttttttaaagttaacttaaagccttcctgagctgacaaaaataaacatgtgtattaatcagctattgccataataatgctgtgcaataaatcaccccaaaatgcagtcccctacaacaaaaatatttattctcatgctcacaggtctgtaagatgactatggttcagctgatgtaggctgggctcagtggggtggttctactgcaagctgtgagttgcttgggcttggttccagactgtgacttgggttcaaacttgctccatgtatctctcatcctccttaagccaagagctacaggggcatcttcttgtcatggcaaatgtcaggaacacaagcaacaaatccttttatgcagtgcatgtaaatcctttgctcacattctctccactagcatttcattagctaaattaagtcccatggtcaagtccaacatcaatggcatggaaatattctctgctcacagtgggaggacactgattttatatatatatatatacacatatacacacaatcttattataggggactgaagaattaagaccaataatctaatctgcaaagcactggttttgaattgtccgtagtctgtctgtgcccagaaatctatagacctttagaagaaaagacagcagtataccagcaggaagtacacatcagattgtttccccagtatagcgatggatttatttagacttacgtcttgtttatcttcctgtcaccatgtagcgttcacaaaaggaactacaaatatcaggatagcaatccgtgatcatgttgttgagattttgcccttacaaaactctcccatgtagagtcaaacatggactgctttcttatcatagtcacgttgcagcaggagcctcttattttatttctataaaatttctgaaatgttcttgcaaacagtacacatttgataaatattggttgaaagagtaggaggcagagtactaatatgggagaaattagaaggacacaaccagtagaattctcacaggtttctgtgctttttcagcatgggaaagtaaagtgttatatcacactcgacatgaatgctatggaaatttatcatctgaaataaatatgtgatcttaaaggaatattaactgagaacatttagcttctatgtggcattatttaagctaacaaaatagcctcgcacttccctatatttcttcaccgttattgtaaggcttttaaaatcccttctggaaacctcaagtttacacatccctctacttaatttttcattgtttatgtgcttcctgtgacgatagctagacagacaaggctgataaaaaagaaagcttgtccttatcaaagacttacgggtaactgtgttaatgtgccttgctttttctaccagtggaagccccctatttcactaagaactcacccatttgcagcatttaaaatggatggaaagttataagccagccaaaatgtccttctaaaagaatgaaatgaatactaatctaattgcccaagaatgcatatgctgggcttggaaaataagccttctacattggttccccctgctggatttgaggatgcactgtcttggaaattgatgaaagcaatatacctggaccgttttatctgaggacatgttactggaatggcaaatccagcattcttctagaaagcatttgctctgtgataaatgtgccaagtgtttcttgagtttgcttccccagggcagaaatactgcaaatagaaaacagtgccgctgagactcaaagagaaaacaaaagcatgccactcagatgtctgttctagggaggggggtagcacacaaggaactaagggtaaaaacccagaagcagtagactaggtaaactgccagactggttgttactattagaaagctggatttcagggtctgaccatggatttccttcttatgcatttacaactattagaaccaattcctcacctttctgtaatttaactgctgtttttctttcccttcttatcttcctcacttcataagtaatctccctacccctactctgtagaagatgtggtaaccagagtactttcaaaggaagcttgtcacctgcaaacttcatggctattgtgaaatgtgttaaaaggtctgtcttttgagggagacagagaagctggcagatttttcctgcttgactcagagtccatttggtgggaggaaagggacagatattggctaagtttttggcacatgctcctgcaccaacttggccttgttaagacagcaagaacagcagaagtgactatttcctccctagagcaaaggccaatgctgtttccttcatggagaaccagaacagggaaaatatcagataatcatgtagtacttgtaaatatgccatttagaacactgaatttaagtggcatgcagagccaccccaggttctcatattatattcaggccaggtgtggtgtcttatgcctgtaatcccagcagtttgggaggctaaggtgggaggattgctttaggccaggagttcaaaaccagcctaggcaacaaagcaagaccctttctctccaaaaaaataaaaaatcagtcaggcttggtggcatgtgccttgtagaccctgctactcaggaggctgaggtgggaggatcgcttgagtccaggagttaaaggctgcagtgagctatgaacatgccactgcactccaggctggacaacacagcaaggctctgtgtctattaaaaaaaaaaaaagtagttatattgtgtccaccgtcacaaacggcacagggctaacccaacacagggggtcctgtacgtatatttattaactgcattcttcgccaacctcagagtatcattcttttttctttttttgtccttctattataaactttttttccccatttaggtcaaatctaaatgtttccccatctgaaactttcttcagtaggtcgttttccagagctgcaggtaaaatgcttccccactgcttctgaggcttttgtttcagctctgctactagtggcctcctcttgggaggattctcttgcctcggaattaagagttggtaggaggaggagatggcgggtcaaagcactcaagcaagacaacgttaagtgattcagtcctgcttgtgggtcaggaatttttaaagggctcagctggatgtctcttctgctccttgtgacactggctgaggtcaccgctcagctgcatttggttggcagctggcagggtggaaaggttcaagaaggcttggctcacaggtctggcccttcatgctccccacacatcttttctccctctctccatgtgtctccctccatttggcaggccagcttcaacttctttacagcatggggattggcttcccagggggagaaagtagaggctgccaggtcttgcagggtagcttgtaggtcccagaatatcacttccaccatatttcattggtctaaagaagtttcacagccagtcaggacttaaagagaaggaatgggctccactccttcagagacaaagcatttgtggccatctttaacccacatgaatataggttggtaacttctgcttctgttttctgtacttcactatatgttttatactttattcttatgtctttgtataaattcatcatttttatttgcttcattttccaaaccaaaagcaatttggagaccctcccagcaatgagttataaaaccatgcctatacttaaccttcaaaaagcttattatttctacagataaatccacagatatagtagctattttaagaaaaaagaaagtttcagatagttgctaatatacagccttcattgcacctgaccagttatttttcagatagctatatatgatagcataaactcaaccaacataatctgttcaagacaaaatattttatagcataggtatgttagactgccatatggaagttaagtgaaaattgaccttttttttgcagcatatatcatacagagaaataaagggcgagaaacttagccaaccttccttacacagtgcatgttacttaagtcaagggagaaaagtggactggagttgaagtttctattatattttgggaaatgccgagcaaggagagacttgttaccgggactgctgagtgaattttgtttactgcggttaaacatttcatctagcaaatcatgtgagaagggatgagtataaatgcacttatttatgtaggtaatttttctgtttcatgcctctgattcatctctctgcctggctttatggggagtcatgctacattggttacaattaatttcagtgctgcatattagccgtaaagagatatttcacaaattgacttgatgcattttttttcctctgtggttttcttgaaagatgagaacggtccagaggagaagcaaagtgtggaagaaatggaagagcagagccaagatgcaggtaggctcagatttcttttgagaagtcacctaggcctcatctgcagaggtgaacagtaacttcactcaatgctattgtctgaaaatgcttatacatttcaccagatgaactccagtgttcattcagggtctccctcaggaagccaccatctccgataactatgagttgagtgctttcaaacagagtggcacattctcacatctcattcaccaattcaattttctgccctgtaacagtttgcctggcaaagctctaagagggacgggcggaggttgaaagtgccaaggcagagcttggctgagttaggtcaagctcaaattagtacatttagcttgagggaaaaaatgaaataaaaactgatgaaaggaaatgaagaagaggcttggcctgcacagtgagtagaatgttctttagtgtattgcattaaattttgaagagctatgcttcaggttatttctctgcatattgcaggagatggtgtgatgggcctgactaccccacacacagagctcgaagtaagatctaaacccttcctgacatcccctctgttcactaaaggacagatgtgtccattgaaagtttatatattccacaccgtagattataaattgaacattttaaaataaaatagcacttaaggctcaaaagggattgaagtcacctgtgatttattatctcttcctatccatttttgtactcagtcatgctctcctttaaaagaatgataggcacaatcattcactcaccaacataaccagcaaaaaaataaaaataaaaatccctgttccctttagtttcccagttattctcccaactctaataagccccatggaggggcacttctgaagtagtgagccctactgtttgccaagcacatcctaggccatatgctgaactcttggaattaaaccaggtagtgtgataagtttttcactgtaaacttcttacattaaccttggagattttgctagggatctggaagcttttattattaacctggaagacggaactgaagaaggccaatcagagaaagcactgaagcaaggcagcaaggactttgtgtacctgtgactgggtcggccggcgtcctttgctgcaagatagtccttgcaatgaaatgaatttctgatgcagaaaactgttgttatccaaccctcccccacccccaacccacacattctgctccatagcagatgagtgaaaagctgtcactgtttttattgtttggggctgacaagtattagtcaacaaactgctgacagctgaggccattctgtgactgttgaggtttcaaaggttttattcactcactatcgtgtcccaaactgttttttttgtttgttttttgttttttgttttgttttgttttgtttttttgagatggagtcttgctctgtcacccaggctggagtgcagtggtgcaatctcggttcactgcaacctctgcctcctgtgttcaagagattttcgtgcctcagcctcccaagtagctgggactacaggcacgcaccaccatgcctggataatttttttatttttagtagagacagggtttcaccatgttggtctcgaattcctgatctcaagtgatctgcccgcctaagcctcccaaagtgctgtgattacaggcacgagccaccacacccaggcccaaagtgtccttatcgaaaaagattgtttccatccctgtacatacatgtacacacgcacactcacacacacgtatgcatgcactcacatacacatgtatgcatgcactcacatttgcctgtgtttgatttattcatcttttccctttaaccagttgagaacaagtagtttgtagatttgagatccttttgcctgtgaggagggagtggtagaatgtcagccctcttctccagcccttgaatctgatagcgttatcaccacaataggggcacttctcaatgtgaagaagggtcctaaatgcatccctgagtgactccccttacttttccaagtgagctcgccggccggcacagaggccaatggcagagtccacctataatcctggccagtgtcaacacacatagttacgttcacactgctcatttcttatcctccctaatcagagctcagagaaatcgaagatgtggttatgggtcgttaaagctcttttgacctgctggtatttttccaaaataaaagtatcttcttttcattcaatataatttccagcttcaattttgattatatagctctgcaggcctcttacacgtcatgaaaaaacacaatcttaaaacactgtaatccagcagttttgactgttgtcatgatcaaatcagatcaaagttgtagataatattcttccaaaaaatttaacaaatacatatcaagggttcattgtgtcataggcaccattccaggcactgaagaataaaccaacaaccaataaaaacaacatctctgtttctttgaaatttatattctggtgggggttccaaacaataaacaaataaaaatgataacatcaatagtgataaatgctttgctgagaaataaggaaacatagaaggaatgcccagaaggcaaatttccattgtctgggtttgggacggactctctgaggaagtgatagttaaaatgagatctaaatgatgagatagtgacagagaattctgttccaaaggacacctgacctgcaagtaatagtacatgcatcatggacaaaagataggctagaaaataagtgatttgtgatttgcttccaaatatgtgttagttttcatgcatatatgagttatctttagttccccgaccctgctactacataaaaaactatgaatatgtatgtgtgcatatgtactatatatatagtttatatgtataaatataccatatatgtataaatatactatatataaactatagagtccatgtagtatatatatgcatatgtaatgtgtgtgtatatatatacacacatatgtaatgtgtgtgtgtatatatatagtttttcatgtagtatcggaatatgtatatataactatgtacgtaactatatatcgctattatatataagtatatagctatacatattttctgctactatatgaaaaactatatatatactatatatgtatatgtatactatatatactctataatttatatatagtatatttatacatatgaactatatatatactctatatatacacatgtgcacactataaatacttttttctatagtaacagggtcatagaactaaagataactcatatatgcatgaaaactgacacacatttggaatcaaatcacaaatcacatattttctagcccatcttttgtccataatgtgtatatgtgtgtatatatatatatatattcattttccagttatcaggtattaaacattgcaaatgattttagtaatcctgcctgtctagatttactgtttgaatgggagggagtaggctagttagctgttatcgtggaggccaaacatgactagagtcactaggggctgatgacactgaggagagaaaggtctactctaatgtagttcattgttgctgtgaggggaacagagagttccatgtccttagtccccattttcccattctgttcttgggtgacatgaaagttcctggtggcttctggtgacctgtgccgaatgctccccttcttccaggcctctgtgctgacagccatcagagctgctccctgcagtttgacagcctggcataatggagcagaagtgctgtgctaagaaaaaaacaaactttagaaacatgcacataaaagcactttgtaggaacttgcaaggatatactttctttcacaatctgttatcaagaaaaataatataccatcctttgagggatgaggaagaaacaaaatgccaaaggatactactagcaacaagtggcattcttcactaagaaatagattgtagcccattggtctctgacttaactgaaggttcctgtttcactaattataaaagagagtcccaaaccactagccccttcaaagagcattcagtgtattcaagcatgcggcaggctcatgctttctttggtggagagtggagggaggtgcagggcaggaaagccacagctggacttccggaaggatgaactctgaggcagtgtttcttttctgctttatagatggtgtcaacactgtcactgtgcccggccctgcttcagaagaggcagttgaagactgtaaagatgaaggtatgaggctactaactatatctaataattgcagactcttaaaagagactgtttgggcttgtttacatggaaaaatgaagcagcaagtcaaatataactaggttttcttaagtgtctctgtttccaatataattgactacaccacctactctcttttattgcatacctagcctgtatagaaaatttatatatatatatatatatgtgtgtatatatgtatatataacatttacatttgttcctttggaaaataactgtttatgaaatgagagaatgatcagagaaattatgtttagagatgtttatttaaaacaccagaattaatcagttctgctctttacagccactcatcaggaaaaggtttgaaagagtggcatttgaggaccaccaaccagggagcaccatttttcaaaaaagaaatgtttgaaaggcatccttagaaatgaatctttggcaagagcatcattctccattctgtcagaagttactatgagaaaatgtttctgacccaagtatttccagaaaaagtaaaaaaaaaaaaacaatttacttttctaggagacagtttgaggaaggaagaagtagggagacattgatctggggatgctacaattaaaaaaatatatatctaaaggaaaacaaaatagtgctttttcttctctctctcctggttcattggcaagtccccagatggaaaagtaatataggcttaccttgttttcttgcccttcattttactgtgctttgaaaatattacattttttacaaattgaagttttgtgggaaccctgcatcaagcaagtctgtcggcaccatctttccaacagcatgtgctcatttcatgtccctgtgtcacactttgataattctcacaatatttcaaacctttttactattattctgtctgtaatggtgatcagtgatcagtgatctttggtgttactattataattgttttggggtgctatgtactgtgcccatataagatagtggacttatttagtaaatgtggttctgactactccactgacccactattcccctgtctgtccccttttctcgggcctccctatccctaaaacacaacaatattgaaattaggccaattaatagacctacaatggcctctatgtgttcatgtgataggaagagttgcatactaaatcacactttaaatcaaaagctagctatgtttaagcttaatgaggaaggtaggtatgttgaaatctgagataggctgaaatctaggcctcttgtgcctagttgtgaatgcaaaggaaatgttcttgaaggaaattaaaagtgctactccagtggacacatgaatgataagaaactgaaacagccttattgctgataaggagaaagttttaatggtctggacagaagatcaaaccagccataacattcccttaagccagagcctagtccagagcaaggtactagccctcttcaattctactaatgctgagagaagtgagaaagctgcaaaaggaaagttggacgttagcagaggctgattcatgaggtttaaggaaacaagctgtttccattacattaatgtgcaaggtgaagcagcaagtactgatgtaaaagctgcagcaagttatcaagaagatctagctaaaatcactgatcaaggtggctacactaagcaacagattttcaatgtagacaaaacagccttctattggatgatgaggccatttagcattttcatagctagagaggagaagtcaatgcctggcttcaaaggacaggctggctctcttgttaggggctaatgcagctggcaactttaagttgaagacaatgctcatttactattccaagaatcctagtgctcttaacaattaggcgaagtctaccccacctgtgctctgtaaatggcacaacaaagtctgtattatagcatgtctctttatagcattgtttactgaatattttaagcccactgttgagacctactgctcaaaaaaaatgattcaaaatattactgcatattgacaatgcacctggtcttccgagagttccgacaaagatgtacaaggaacataatgttgttttcatgcctgctaacacatctagtgtgcagccaatgtatcagggagtaattttgattttcaagtctttctatttaagaaatatattttctaagactgtaactgccatagatagtgatgtcatcctgtaatgaagctgggcaaaataaactgaaaatatggaaagggtttactattctagatgacattaagaatattcctgagagaaggccaaaatatcaacgttaacaagggtttgaaagaaggtgattccaaccctcatggatgactgtgagtggttcaagacttcactggaggaagtaactaaagatgtggtagaaatgtcaagagaactagaagtggagactgaagatgtaactgaactgtaatctcatgaggaacttgaacaaatgagaagttgcatcttatttattaagaaaaaaaagtggtttcttgagatggaatctgctcctggtgaagacagcaggtttgagagtattgagttcaattttttgtttgtttttgagatggagtttcactcttgttgcccaggctggagtgcaatggtgcgatcttggctcactgcaacctccgcctcccaggtgtaagcaattctgtctcagcctcccaggtagctcagattacatgcatgcaccaccacacctggctcttctttttttttttttttaagtagagacggggtttcaccatgttattcaggctggttgcgaaatcctgacctcaggtgatccacccgccttggcctcccaaagtgctgggattacaggcaagcaccactgcgcctggcctgagttcaattttaagataatttctactgtgggtaaaatgccatcaaacagcattgcatgccacagagaaatcttctgtgaaaggaagagacaattattgtggcaaacttcatcactgtcttattttaataaattaccacagctacctcaaccttgagcaaccaagtggtggccgtcaacattgaatggccagtagtggctatcaacattgaggcaagaccctaaccaggagaaagattacaagttgctgaaggctcagatgatgattagcatattttagtgaaaaagtatttttcagttagagtacattaactgttttttaagacatagtgtatctaaaaatataactgatgtcaaatacccacataggctctgataggaaaccctaggtcatcttagagagacaaataaatgtgatcaaatgtgatcagagcgaaaagacagaaagtggtgttcaccttaagcaaaaattttggacataccaatcatttagtttgtgataaaaattttaaagtgtcatgaagttgagtggcagagtttaagaaacatgaaagagggataatttaatttgaatgtgaccatgtttcaggctgggatttttcctgttgagttgtttaatttggagatatcacaccttcacagaagcacactgtttgtgatgtttcttgatgcttttaggaactcacaccattaattgcttatgccaggatccatgttttggaatacttttaggattttttttaacataaaacttttaatgatggtaactccatgaaggagttctgtcatgtatcacaaatgcagttcctatgtaagactaaatgtgaagttttatgagtattactgaaataagccattaatatctattaacctatttacttagggaaaatagaaatgttttgaaatccacactagtatgcaagcttctttcaattaaaaacagaatgcctagggtatgatttttgcctttttcttctgaaatagcatgtatagaaaaccactgtttttaattgattatcagttcagagcttagaccagcttagaacaagtgtctaatgcttatggaactatcatcttgactgatagatacctagcttagaaaaaaaaaatccgttgaaatccttcaagattgaggtcaagataaggttaaaaggcagtcatatgcgtggaggattcatttcaaacattctccattattagctttcatgcagaaatatctcttctcagtgacatctgggctattttagagctctgcagttataagattgcttatagaaatgctcattacactctccaatttaagtggcagaacatttttgctgatcaaatgtcctgaagaagcccttgctctcttgagttcgttttcagactttgatcctgaccaagcatcttcttgggctttagaatcactgatattatggacaggtctttttttctctttctaataaaactcccaaggattttgaggctcattcagttatttccagctttgcttgttagtgggctggctttacatttgttacaaccttggtttccacaggaaattagcatcttctagggtgaaagtattgaaaacaaacaaataaaaaataagatggctaatgtcactttggagaccagatatttaaaaaattcgaacagtcatgggaaagttgaagaatttcaaaaggaagtattgtagtgcaggtgtcctctttgccagcagttttgttttaatgttctagacatattttccactgggaaccaggaacccatgtttgctgcctgcttacccccatgtacttgctaactgtgccagctgccaacagaaggagatgcaactgactggctcatggatcaagagctagattgtgagctacacactgatgacacctgttcccaatgagccattaaagccatagggtgggcaggagttgagctgggagcatgagatactagcaggaagaatgctgatgaataattcatccggaatgcatgccaaagatttggcaaccaggattgaattgaaattaactccaaggtaaagctggcctgggaaaagatttgtgggttggtaggcattttgaggttatttgtgaaataggatgtgtacttatctattgaggacttctttctctactggttaaaaatactctgttgatttaatggtagtttgcactttaaatccttaaaaacaaatttaggagtacaagtattaaggctatttaagttaacaaatatacaagcaatcacattaaatgggcatataaacacaggaatgtcaagtactccagatgaaacttttacaaagttattattattactatttaagatatagtcaacctctttaagataaataatatgctctgttctagttttttcaacacttccaatagctcattttcacctagagccaaggctaaggcagctttctgggggaaaataaagtgctgtttaaactcgtcttaatccacctgccttattatttaatcagtacctaatttaaatttgaaggtcaactagaccaaatcatatgctcattaatattaaaaacaaaatcaattaatactcaggtgcatacccaggcttgtattcctttggaacaccatgtaagtcatacaattgctgtttttggtatttatgaaatgggatgtcacctggcaaaggatttattaactcttgatctagtttcagacctcttagaagtcaaaattgctgtaggaaaaggggaaagctagagccaagagtcagccttgccaaagtgaacaaaagagaaagactacatacaaggaagagaattcaggagtgtgcaagagatgagagcacaaattattccaaccactgagcactgtaggcttggccagtggtgtggactcaaaattgctctggaaaacggcattgtttctgttctttgcctgaactgttgaggagaaacaaaaccaaggccaccaatgaattcctctcgagactctccaggctaatttttctttgtcctattcccattcttggtgttcaccatcccccactaagcgtcctcaccccatcactcatcagagtgaggacaaggctgtcctgtgccctggatctgcattggtagagtgtctgaatatgcttgagtatctctgagttatccctcttggatattaggagccttaagtgtagaatgaaagtggctgtcctctgctagtatactgaaggggaaagaactaagatacattgagtgtctcctgtacacaatgctttacatttataacaatgtagtcttcatttctcaaaagggtcacctgagactcagagaaggagagaggaaaagggtgtgtgtgtgggaagtgaggataagaaaatgattttattatggttaaccgccgtacctaatacctacataagcttatacaatccctttaaaaggtagtatttatcatatttttaatataaaaattatttttgcttataagaataatatatctttattgtaaaatattttttaatgtgaaaaatatacaataaaagcatatagtcattttccctttaaggattaaactgtaggaaaataaaagtctttattctattgcttcatttaacaataatactgtgaatatttgcccatgtctttagaagttcctcaaaggcatggattttattggtgtcataatattttatcatctggttatcccacaatttacatagccagtgccctaatgttagataacttagttatttatagttttcttcctattacaaataatagaaaaatgcagtgcctacattttggataaatctttgtgcatatctatgatcagttcctcaggacaaattcctggattttattgatttacgagggaaaaggttaaaacatttgtattacttacatatattttcttattttaaaagtaatgtgtgtttattacacaaaaaaaataagcaaaagaaggaaggaaaaatatcactcataaccctggtgcccagaaataagcatatgtaatatactgatatataaactctcaatgtttttctaggcaacctcatacatatatggaaggggtttttttagggtattctgcaatgcataaaagtttgaacctgtctttcaaatataacagtacattgtaaaattcttccaacatcttttgatagtctatcatcatttaattgtgtattccagtaaataaatgtttatattcttatccagtctcaattttgaattgtttctgtggtttcagttttaaattccatactgaccagaaacatccttttaactttgtaaaatgatcatgatcatttctgtaagaaaattctagtaaatgtgaatgcatgcaaatttgtgtgttttctacaatgaatagttttttaatttttttggttgtttaattagtatatttattgtataaaattcaaataatggaagagaataaaaaatattacatataatcacatcacccagagacaactaccattctcattttggagactatctatcatgcatctctttctgaatatatgaacatacacagctttatgtgaaacgtatgattgtaatgcaatttttctctttttgttgcttatgtactcctcaccattcaatcactcagagagtaaaatacatggactaagagtctaatctcttcttccaactacttgggcccagattccaaccctaccctgactaagctgtgtgatctttcgcaaattatttagtctttctactcctcaacttgagtttcctcatacataaaataagaacactaatagcacctacctaaaaaatatttagcattaaaatcattcagtccatttaaacattttcaaggtgttcctggtacacagtaggaggctcaatttttttagtcattattaaatatatatatgtttattttacaaatattgtattatattccacataccttgctaaatcttgctctgctacaggcagccaaacttggtggaagtctctgccagtcagtttgcaaagatctaattaatccattttaaagctcacatgataatccatagtttggctgtaccataatttattcaaccattctcctatgataaacaagcactttttttccactctattgccacatagactatgctgcaatagacatctttgcacacatatccttatatgctgatgcttttatttgtatggaaagattccagaaatgtgagttctgctttcagcagtatgtgtttttaatagatgttgccaaattgctttcccaataggctatagcaattcatatttctatcagcaactgttatttttgttctttctgatttttgacagttcaatggatgtaaagcaatctctcattattacttttaaaaagtcatcagtgttattatcccaattttgcagataactgaggctcagaaagtttgaatagctggatcagtttcccaaaagctagaaccagaatttggaagccaaatctgtctgaacccaaagcccatgcattttctatccaccatgctgcctcccgtatcatgaatttggagcagaggactttctttgcctgagtgggtaggatgcaggtgtgtctagagaaggcagagggtgtcatgggaaccctgcaacctgtgcaaggtgagcagggattggaaccacggcaacagggagggcagtttggagctagctgcttggtccacctcatgaccttgaccctaacctaggaactacaatgaaatgagtacacagaaacctccagtcatgcccctgactagatgtaaaacccaaagcactttgtattatattcctggtccttttgtgcttccttagaccctgcacgtgccttacgctatagcccaactcagttatttgtcctttcccaaatgccactggtctaaagcattctgccctcacgctgtcacatccattttgttctttattctgtatatgaaaatcctgatcatttttcagagtcactctcaatatctttcttgccctaactagaacctttactccatccttccctccctcccatccttccttcttccatcacaaattatctgagcaaacattacattgacagaaattataacagataatacaggtgaggggggtggtgcatgcatattttcacctttcttgatttctgttctcttcattacaattcaccccatagagtagtaactatcctgcttctcataaattcgtttataaaccttaaatgttatcatgaactatattgtatcaatattagttatatacttatctaactcagtagaatgtagacctcttaagagtaggtacaaaatctcattcatttttatgttctccacaaagctcaatgcagggggccagcccctccacacctgtgggtatttcttgtcaggtgggatgagagactgagaaaacaaataagacacagagacaaagtatagagaaagaaaagtgggcccaggggaccagcactcagcacacggaggacctgcacaggcaccggtctctgagttccctcagtatttattaattactatttccaccatctcagcaagaggaatgcggcaggagagcagggtgatagtggggagaaggtcagcaagaaaacacgtgagcaaagaaatctgtgtcacaaataagtttaagggaaggtactatgcctggatgtgcacataggccagatttatgcttttctctacccaaacatctcagtggagtaaaaaataataaagcagcattgctgccaacgtgtctcgactcccgccacagggcggtttttctcctatctcagaattgaacaaatgtacaatcgggttttataccgagacattcagttcccaggggcaggcaggagatagaggccttcctcaatctcaactgcaagaggctttcctcttttactaatcctcctcagcacagacccttcacaggtgtcgggctgggggatggtcaggtctttcccatcccacaaggccatacttcagactatcacatggggaaaaaccttggacaatacccagctttccagggcagaggtccctgcggctttccacagtgcattgtgcccctggtttattgagactggagaatggcaatgacttttaccaagcatacagcctgtaaacattatgttaacaaggcatattctgcacatccctagatcccttaaaccttgattccatacaacacatgtttctgtgagctcaaggttggggcaaagttacagattaacagcatcccagggcaaagcagttgttcagggtacaggtcaaaatggagtttcttatgtcttccctttctacatagacacagtaacagtctgatcgctctttcttttccctacactcaacacagtggcttgcacatagtaggtcctcatatttgtttaatcaaaaggaataaaatggtgtgtacataacagtttctataatgctgttgatgatttaacagtttcttggagaatttaattgagagccttgcataaaattagagacttcacatgactctagaaagtatgaatgggaaattatctggaattttttccacaagaattaactagagaattggagatagaacctatcatagaaaatgggccactttttgctggtgcatccaatgttgatgacatcgaaggcacccctcctgaggaaatctcaactgcatgacccctactatgccccaattcagcaggaagcagttagagcggtcattggccaacctccccaacagcacttgggttttcctgttgagaggggggactgagagacaggactagctggatttcctaggccgactaagaatccctaagcctagctgggaaggtgactgcatccacctttaagcatggggcttgcaacttagctcacacccaaccagtgaggtagtaaagagagcttactaaaatgctaattaggctaaaacaggaggtaaagaaatagacaatcatctatcacctgagagcacagtgggagggacaatgatcggcatataaacccaggcattcgagccagcaacagcaaccccctttgggagctctgttttcactctattaaatcttgcaactgcaaaaaaaaaaaaaaaaaaaaaaaaaaaaaaggaaaaagaaaagaaaagaaaatgggccacttttaattctaatattatagccactttcccaaatttgttttttactatgattaagattcctaataaaagaaattccctttcagaattctcttgtttcagaagtaaattttcccaaaactttcacactgcagaaatataaaagtacattcaagcccaagacttttcctatttgttcactttcagactttgatattcttcccctctaagagaataaaataaacttcttttaaggaagtacatgtttatctactatttaatatagtttaaaatattcctaagtggcaattggaaggtaagtggtagttcctttccaaatacactttaatatgcatatattacttttccttactaattaagtatggctataataatatatttgtaacagtcaattccattacatgctctcttgggacatatttctaaagatcttgtgaataagacttgtaaacaaaatcatcctagactaggacatggagattatttgaatgggtttacaattcctttgtccaacatagtgttttggacctgaatttacatccaaataggtccaaatttatatgagcatccttgtgataattttcaaatttagtggccttgtttttgaattccttgggccaagccatgaagtctttatgagtctcaatttatttcaaattcacatcaccattgctgtgtggccttaggtaatgtttttagcttgtgcctccgttttctgatgtgtaaaaaatggaattgtaatagtatttatatcacagggttgctaaaactgaaagagttaatatatttaaagtgcttacagcagcttctcaaacatagtaaactttgagttggcagcattattgttttttacaattattgttattacatttatttgctggctttaaaatcctaactaccccaggtggcacagtgatatgtcattgaatcatcaccaaatcaagaaatctattgatatgctaacgcaggttagagaggttcagtaacaggtaacattcaaaatatttaacaacagatgttgcccagcccctgaccatcaagatgagcattctccagtacaccatagggcgtgcaccagttgagtattgaaaagcaaccagagtaaactatgccagcaagcagaaacacctaagaaatctctacctagcccccattccccagtggagatttgttaactgggtatcttcgcttgaataccagacattccattggtgccttccatagatttttctgcctgctttgtgttttattctcttatagataagacctagaatggaaggtgcctagtccatattttgaaatgcttttgtgggcatcacctaataaaagtaatcatagatcttcaaaaccagcacaatttttagagtgattcgcactctactctaccagaataattataccagaattgacctgattcactaggactagagaaacccaagatgtatacttacccaaccaaaaatgcatgaagtcttttctgtctacaaattaaaatcataatatctctgactcatatttttaaatgtttaactttgactcccaaaagtgtactatttttaagagtatgtatttttctgaccctgtcatttcttgttaattagtataaaaaataatatttggagtaactctttagagtatttccacaaaaggtggtgtgtctagccaatctgagtaaacacaaaacatttactagttaagtgtagtctatttttctataaaatatcatttagactagctcagtggttctcaaactttaatgtgcattggactcaaatacacattaatatttgaatttaaaaataaatactgtaatttaagagtttttaaaagtatttccagagttaattttgaaggtatgtatttttgacactaaatagataggactgtactcagggcaggtggattctgacagcagcaggactctcatagcaggatgaggaaggagggtgtgttaacctaacaggagtggcctctgcccaggagtctccacaaggccacagaaagcccaaagatccatgtgtcaccaactgatcattgtaaataaagtggacctgcttctttaaccctgtcaaaaaagacaaaaacaaaaactaaacaaagaggtggctctactgaaaaacagaaatcatgacaatagttcatgtagaatggcacgtcattgtattttgactgggcaaaaatgctggaaaacggcacttcctttgaagtgaattcagatctataagcaacacggtggggctcttgctcagatattcccatgtttaaaattttatagcatctttgatgatattaataattgttctttgataaatgagttcagcagtcaaaacattttggaaactacgaaattaggcaaagttaagtggtttttctgtaatacagaactcagagccttcagcatgctaacatgaattgaaatgctcaggggagatggaagtatggggcgtttcccacgttaattaactaaatgtgattttgtgaaattttgtttgcttgctcgccccttttttgttggtagaactttctaaaagtcatacaaaacacagtttgggaaaccattccacatcccatctggaagaactcaagaacgcagtttaaagttttgattttaagaaatcatacccattgttataatacaaaataggcaatggtaaattaccttttaaaaatggagtctggccttcttgaatttatggttatggagtggtatcggaaaaacattctctcaagtttcagaaagggatgtagcctatcttagtttttgacaatagattttcacaagcaggaatgttttgctctgactcttttctaatgacatttgttgtcagctattctgccactgttcctaggaggatatatttatctagacacacacacacacacacacacacacacacacacacacacacacaaagagagagagagagagaaagagcacaggggaagatgtctcaactgctgcattctttaataagaagaaaggaataattggctggctagtggcaagactggaacattttttaatcaagtaaaaagacaaggtttaagcattgatggcatttaatgagaagattgttttcctatttcattttgaaattagccctgttattttgcaccagatgtgtcaaattagaatggaaaggcaaaaattgattattttcctcaggcacaaggggcaatgacactcacataaacatatatgtgtactcaaaacaacatgcaagcgcatgcatgcacacacaccctgttttgagaacaaacacaaatatgtgcaaggcgatatttctcccagcctgactcatacataaaggtctcataaagatctatggttttcaaaaagcatgtaaacccattacactgtttcaatttacgtaaatcacccgtaaatgttatctatgccaaccacacctatcttaaacacggaatgaggcagaatcagttactaaatattcactgaattctatcctaaacgtgttatgtgatatggtttggctatgtccccacccatatctcatcttacattaccacatgtagtgggagggacccggtgggaggtaaatgaatcatgggggcaggtgtttcccatgctgttctggcgatagtgagtaagtctcacaagatctgatggtattatatgggggagtttccctgcataagctctctctttgcctgccaccatccatgtaagatgtcacttgctcctccttgccttctgccatgattgtgaggcttccccagccatatggaactgtaagtccattaaacctgtttttcttcccggtcttgagtatgtctttatcagtagcatgaaaacagactaatacataatgagacaaatatttctgtcaacctcttcctcagggtggatggttaaagccttgagaccactccaagtaccaggcactgggtttccctgaatcttccttcatggtttcaggaaaatcagaaaccattttttttttttatcagtactgcatctttctgcatcctgcttctggcttccagcttcttgcttcctgcagctttctgcctaccagaatcctagtgtagaccactctagacttggatatccaaccacctgatttatcatctaatactgacatataccagcatcagcaggaggaaaagcaggtaaacaccaccaagcatccagctcaagcttaccctttcgcacgtacatctccctcttctccacagtattgtccatggtcaaagcccctcccagattctttcctgggggcttctctcaagttggagccaacagagcacaccagactttaggggaacacattagttgaagagctgccctgtatcttccagagatggatgatattgtttgtatttccctaattttctctaattttatccaaccaatacttaggttgggtaacatgcctgaagccacacaagttgaaggctgaataatagatttgcatctaccaccatgccaccctgaatgcacctgatctagtctgatctcaaaagaatagttttgagaagagacttttcgaaaactctcccatttctgtgggggtttcttttccttatgagtctgctcatgataaacatacacaatggaatattatttagccataaaaaaagaaagcctgtcattcgtggcaacatggatagaactggagaacatgatgttaagggaaatgagtcaggaaaagaaagttaaacaccgcatgttttcactcataggcagaagccaagaaaggttggtctcatagaagtaaaaagtagttcaggatactagaggctggaaaggggagggggaagtggcagggatagaaagagatgtgttaaaggatacaaaattataactagatcgaagaaataaattctagcattctatagcattataggatgaatatagttaacaataatatacattatagtttccaatagccagaaggagtatattgaatgttcccaaaacaaagaaatgataaatgttccagatgatggatatgctaattaccccaatctgatcactctatattatacgtattgaaacatcaccatgtaccctatgaatatgaacaattattttgtcaatttaaaaatgaaataaatttatttcatgtaaaaatttagctaaaaaaggaaacacgcatacacataagttaaggcttttttgaatctcagctaattcagcaaggaaaaaatgagtgataaatacttgattttgtaaaaacgtttctgttttcaaggaaaatagtatgtttcaggttgtctgctgtttttaaagtcagtgatgcctagaactaaatgatagtatgttttgatttctgcctgctctgtgttttacagcagactcactctataatttttattacattttcattatttacatccttattccaaaatcatatttgaagtcgttccctcaaaactgacacctgttatgaagcaacagggtctttacataaattaataaatgagaatgtcacaatggaggttcagatagaaccctgattcatgaatttgctcactgttttttcttgtggcagaaaactaattatatttttgatcttggagttcacacatgcatgtgttaaacagatagctggctttaatgagcccaagattaagtgtttatgtttgaaccctatataaatgagcaaacctttatataagtcaaagttcagggtcatattaatatattgcacttgaagataatttcatttcataaattgggtaaaaagtctatcaccattaccagacaaagcaaagtaaacagatcccagcacactccttcttgaatgcccataataccctcaggtttccctccaagtaaaatgcaaatagctcactatagcctgttaggtgcacctttccattgcagactttccctgtctctccagtctcatctcgcacctctcccactcctctcattgtgcttctgcctcaacacagctttctctggtcatctttttggtaaagccacctccactaaacctccatctcagcctcctatgtgttgctttataacactcactgccatctctaactatgtaaatctttttctgttgttgtttgcatgctttcctcctatccatctcccactactataatttaggtttcatgagtggaaagacagtatttatgttgtccaccattttatccctgtgattagtacacagtatggcctacagaggtaccaattaaaatttattgacatctcttatggccatcaacagatatttattgggtcttaacttttttaagacattatgcaatattaaaaagaaaatacagttcctgcctttcaaggaatttacaatctagatggaaatatgagatatacaagcatgtgctacatagctaatatcagcaacaataatatcagcagctaatatttatcaaatccttattatacatcagtttctattctaagaactgcacatgttttcatgcctactgctctcatctatgatatgaatacaattaccatcccactttacaaatgaggaaagtgaagctcacagagcaataacatagctggcctgaggccacataactaggttgcagggcagcaaagaaagtcagacagatcatggtaagtgttaaaaaaggattacattgaaacatactaaggagcttagggttgaggagcatctctgcttggggttgtctgtgaaatgtgggtagagaatatgagatttgggctgggatgtgaagggtgtgcaaatggaaggtattctagttgggaaaaagagcatctttgaaagattggaagaaggacatcagaagacctattttaggtacaatgaataaacccaattgacttaaatgatggatccatgacccactcattaattcgttgctgacacacagtcctgattatggaggactctgaatatcagactaagaaatttaggtccaatcaacataaagcaaaaattttcaaccattgggtattgttcaggtgtaaggtggtttgggtagctgttacaaatgtaccattctctttcatcctccaattccttctcagaacattctctagttaggtcttcttcccagccatttctgtcaccatttgcagatgcttctctataagccaaattagatttcctagtttctaatggatgatcctttggcaagctataattttccatcttcctaattctgcccttcaaataaacacgtatttaagtatttgtataaatcaggctaatgctaaattatctagaacagcactgtccagtagaaataaatgtgaaccacaaatgagaactacatattagtagttttaaattttcaaaaaggcacactaagaaaaaaaaggaaaataattttaattatacattttatttaaccattatatccaaatagaatatttgcaaaatgtagtcaacataaaaattattgatacatgcatcaggaagaatagctaatggatactgggcttaataccagggtaataggctgatctgtgcagcaaaccaccatggcatatgtttacctatgtaacaaacctgcacatcctgcacatgtaccccaggacttataataaaagttgaaggaaaaaaaaactaaaaataaattattgatacaatattttacattctttgtatgtgtatgagctaagtctgtgaaacttggtgtgtattttatacttacagcatatgtcattcggactcaccacgtcacaaatactcactagccacatgtggctggctggtggctaatggattggacagtgtctggatttagattgatgagaatgtgttgtaggaattgtctattacttttagtctttaagctttgttcttaaggagttcttgcctgcagagtttgatgcaatcagtaatgatatgacctgagcctttcttgattccacagattagtttgttgttcttcttcttcttatgaatgcatgccaaccaaagagtttcagatttttaacagtaagacccactaaatctaatgtgaaggagagatgctttgaaaatatctcttatatcttcacatattgatggggagctcccagattctgtcactcagagagctgtgcatccctcctcatcacatgttagaggctgctctctctgtagtggaaaatctgtgggcagtccacgtgaggatacttatccaaaagtcctactttaaatgaaagatgtcttagacacaaaaacgaaatgcatacagatagatacaaattcagtatatgctaaggcaatggctctcaaagagtgttccctggaacagcagcagcggtgtcatctgggaacttgttagacatgcaaattctcagtccctaccccagaccttcaggatctgaagctctggggttggggccccacagtctgtatgctagcaagcccttccagggatcctactcctaatgtacactaacatttaagagtggctgtagtaacaaaataataagttggagacagagtataggagagcggtgaatgttttatgtttgaaaaagaaaaaaatactattcttactcttcaaaaaagatttaccgtagaatctgctgatgtggccagccttcagagtgcaattaaaattcactttcacatgcaaaaatatgaatgaatttcacaaacgtaatgttgtgcaaaagcaagaagacacagaaaaggacaggttatgtgtcattcaatttacgtcaagtccccaaacaggcacaacttatagatgctgttgagagttagagtggtgatgattagagtgagggtagtggctggaaaggaggataatgggtagaaaggaggaaaatggtagacatgttctactgcttgagctggtcctggttatgcaggagtattcattttgtgataattcatcaagctgcacacttaagaattttgtactttaggtatgtttatattcaacatacagttaagaatttgaattttttacaaaaattatgaatgcaacttttgggaaattttttagtaatgtgaaaaacatgcactttaatttggcagtctcacagttgtttctcctaaataacaaatagaggtttacctttaaagtgacccacttcatacgtctctaggttggagcataaacatacataaccttgatgctctctcatgacctctgtttaattaagatccttccctccctcttggtccctgctcaatgccatcctctcctgttctcagctgactttggactaatctttagcaactagttattaagtcattactccaaatgtcacaagtgggatccttccaaggagctctgcattttaaaaagtctcaaaaggcattctgcccaaagaaggaagtctcctctgggaagtgtgaggggtcagggcgggtacttaggaacagatggccttatctggcccccttatatctcccaacacggtggccatcagcttcacctaccaacgaggctggcctgatctgattgcatgagttttcctctccagtgatgtagggagcagtggggtggtgtgggtgtgccaagaggcaggggatgtgctgctggcctaaagagatgtggtgttccacacagaaggactaacccaaagtttttgctggttctatttgcaatggtgctttatcagataaggaccacaaaataagaggttatcacaaatatgtttgaggattattcagtccttagattatagactcttagggaaagctacttcttattcttttcatcaatatgagaacatcagagacttacagttaatgaaatactctcattactttttggaaaatttatcaatatatttctctattatacacagaactgatattccgccagtacactctaatcctgctgcaagcatttttaaaatactgaaacatttacatagtgtccggcaaacaaagattaatgcctctcctttcaagtgacccttcccaccacctccctgccatcctaggacaccagcagggctccacggccttgccccacagctgtggacatgtgcattctgattagccaacaccctaccagttattaagtgttttgaatatctctttggattccctcatgactactttatccgtgctatacaaacactgacaatgtggtgtattttaaggatcaaatgaaaatgtgatgccagagaactgaaatggagaaagagaaccttggacttgggtaaaatcccatttccaaatctattctgaggccttcttctgatgtgcagcaggtatactaatttgaatggctgacattcaaagggaaataaaccatccaagtatccatgtgcacaaatgcatatgtcagtgctgtggacttcgtgtttgtcccctccacccccaacaaattcatatgttgaagccctaacctccaacgtgatggtatttggggataggacctttggggaagtaattgaggctagatgaggttatgagggttggtccccacgatagaattagtgtccttataaaaagcaggcacacacactgaggaaaggctatgcaggaacgtgaccagaaggcggccatctgcaagctggcaagagagccttcgctggaaaatgaactggccagcaccttgatcttagatttccaacctccagaactgtgaggaataaatgttggttaagccacccagtctatggtattttgttgtgtcaggccaagctgacaatatagtcattgcgttaggaaaatctattataataatttctagaactcatagttaagcctactctaataaaataatagcagattaaaacaaaatccttctataattgaaaataacacttttaatttaatcttaagtattcttcttaaggttcttgtaagttttttacagcattttgttttaacacgtttttctcagtttatgaggcaaaacattgttcacattatacaaatacctctgtacaccctatttcctgtaataccagatgtcccctgatttttttctaccatcagggtgatatttgaaaatgaaatttactgaacctgttttactttgtatgaccaggctgtttcgtctttaattttctgtaagttaattggcataatgcctttcagcccatgtataagtttcgtgagtactgtacagtttgaaatgactaaaaaggtgagtggtttttacaaatggatctagaataatgccaaacttcttaaagtaatatttgttttttgtttgtttgtttgtttttgagacagactcgcactgtgtcaacccaggctggagtgcagtggcacgatattggctcaccgcaacctccgcctcctgggttcaagcgattctcctgtctcagcctcccaagtagctgggactacaggcacccttcaccacacctggctaacgtttttttatatttttagtagaagcggggtttcactatgttgaccagtctggtcttgaactcctgacctcgtgatctgccctcctcagcctcccaaagtgctgggattacaagcatgagccaccatgcccggcccaaacttcttaaagtactatttgtaaaaaaaaacactttagaaatgtttaaagtacatatacacattaaagttaaataatgaacttgcaagaaccacaaagtgagttagactatttcaggttatacaaaagtgatacacactgaggttgcttggttggcaggaaagtcagagaatgaggaaaccatttcagcagccccatgaactggatcacccaggaggcaacagccattccatcagttcctctagagactcaacaactgttctagtagccatccactcaaagagctgatcaattcctttcacagttaagtgaatattaattctctcctggtatgtggagctctcatgtcaggccaccttagtgtctgttggtcaagcaagaggtgtctgcttagggcctattactcaccagtcatctgtgacccagctactagggtcatacagtgcaaaacacggtaaccctttttcccaacttgccctaattaggtggcagaaactttccctaacactccataattaaagacagcatggtgtgagagagcagcaggctagaagtcaggagaataggatgagcattctcatatttgctactaagtggtaggagccagatgaaggactatcttggttttctaagtttcggatccacaaaagcaaatcggggacaagattgtgggtgcaaaaggtgaacccactttttatttgggaggtgttctcaggaagcacaggtgaggtgtgaggaagtgggacagggaagggaggacagcccctaggggatattaatgatcaagttactgctgagggaaactgagactccgttcccctaagagatgtatagagtgcattcagaaacatctccctgaagggtgaggaagctggggtatttatctcccaaatccttgggggtccagagctgggcattaattcctggttacttctggcccatccaggacaagagtgccctctgtactggcaccatcggctccaacctcagggatagtccacagggaggtgggtggggcacgttggctacaaggcttagcttgcatgggctgtttttgttctcactactctagctctagaaagatctagcctctctagatgtcagaggtggagatagttgggaaggagtaacagaaggagaagagtgaatccagcctttgaacctttactacaacaatttataattttttagaaagtccccaaattggatttaattagaatgtccagaaatagaaacgattgtaaaatagcatgcggtagagccacacgatgagccactctgcagccacccatattttaaaattatattcaatggcatggagaaaattgaagaaagaaaaaaacagaaaaagtaagcacatgggggaatgggggcccatgatttcgcctcagttctttctcactcaggtgagtttgtggatccttctaggtgtcaggaataaattgatgttcgggagaagtcatacaggtctttgaagctcaacatagtatctcccacaaaggacccaaatgcttgtctcactctccaaacaggtgcctttacatttggaaaaaaaacccaagttctgagccaacaaggtaggttatatcttagtccttgaaattcttggatctcagcagcaacactcagccacactttccaagtgtctggctaaaagcaatctgagcccagcagttgctgcatttatgaatctggagagaaattctgtctcctgcctcaacttctccgtaaaataaaataactcagaagcagtgacccgatgccaggctgtcggttcagagctaaggccacaaaagcctttatcatttttcctaagaaggttctttcagtaatacagtcaccatgacctttcattatcagatcaaattaagccaagctgtaaataaaacacttgtactctcccagatttatagatgaacattttaacagaattccaagccctttacattcagaaccatagatacttctcacacccatggcctggtaagattttattttttaatgttatcaagagagcctgtggtgtgaggcttagtaagagagagggaggcaagatgagaaagaaatcagaaggatggaggtcaaggatactgaaataaccaagtcacagacaactgaaaataagagcagatttgcctttgtttacattgccaaatgggaaaaattaacttgattgaaagggtaattaagcatttctttttccatcatggtccaaaccagcttcatattccagctgttccgttttacattatgatgattctttgttgagtcgctgacttaaagacagccagtgtggcactggtgcacaccttactgcttctcccactatcaacctttattttgtaagtacacagttaaaatctcagtgagaacggtccaactcaggtaggcggatgatgaaggaagagtgggaacatttacaaagaagtgttgctggaacaaagagataatttgagcaaatcagattagctttgtaaggtatcttagagagattatccagctcaacagctgtagttcctaggtgcagaaactgagattatgtaaagtgcctgaatttccctagagttatgaagcttgtagctctaaattctgaatcacaaccctatgactgcatctctcatttgctagtattttcaataacaacttgcagaagaatatcaccttcaatgtaagaatgagctatttcacaccagtttattgtttgaaatttgtgttttctaatagaaatcaaattaattgtgcattatggtagttttcccagccatgtctcaaagactgttagcacacagggtgatgatccctaatttgaaaatccaaaatctgaagcccttctgggcccaagcatttcagataaggaacatcaacctgtccctgaattccatatctctgggaatgattggccatcttttaatggaggttaatgagaccgtaatgaagacaaatgaccaactatagctcatttgggtctcctgatgccctgagcaatgtcctgtctgtgggccctgttacctttcaggtaaatatagttcagccttatttatccagcttcactgggaccaagcacagttcagatcatcagcatcagaatagtctgggaatgtgttgcaggatacttttttcctatataaaagagtagccgctgcaaagtttcagtaagaacattatctgctggagagactctagtttatttagataagcacctggttcagatggaggaaaaattactttgtcctaattgctccacataataagccagagattctatagagcaggccaggataaatgttttgcatagtataatcaaatcagttaacgagaatcaaagaaaatccaggtgatggtgtttctgtgcaatttttgcatcaagctctggtactcatgtgtagacatttacgcattacagagaaagactattttatgtgtaggtttttgtgtatagcagtttttttttggttcagacccattagaagttctacgccaaaatgacctgctgtcatcactctgaataatagtcaggggcttcctctcttactcggtgcgttttttagaccacctagcttgaatagttatcttcaaagacagtgaatcatgcagttagttttatactttatattcacctctaattttggtgcaacatggttttttgccagttggattgtccctctcatttatttaacacatctctatatttgctggctatttcctcaaatcaaatctaccttaagaattcaagatttgccatcactgattaattcatggagcaggaatcaagctcagtagctaattcctcaaaactggtctggaaaatcttttgtaaaatggcaatgtcatctttcaccacagcttaaatccatacatgtaatattctgtgtagatacgtgtaattgactgcattaaaagtgacctactttttggaatttctgttttatgaagtttttcattttattttaatctattttaaatattcctttaaaccttttcaactttctgagtgagggctttttcttttttaatttatgaaagtgtttcttttttattcttgttaatcttaaaagcacatctatctacagccctttggcttgaatatttgatttaatatttgcatttgaaaaaattctttaaatatgacattgaccttaaagattttgaaagtcagaagctacatataaatttaattccagttctctgttattaaaataacattgactgaatctcagaattaggtgataactgttttacatgtttttgaacattaccaaatgataatttttagaattaagtaaaatgcaaatccaaggtgctgcaagagttgtatatgcaactacatttttcagggtagtttatagaacttacatggaaataataagttattttagtgaccatatacactggtgtcttcgtccaggctcctacaacaaaataccattaactgggtggcttataagcaaaagcaatttatttctcacagttctgggggctgggaaatcaaagatcaaggcaccagcagattcggtatctggtgagaactcactttctggttccttctaactgtgtcctcatttggtggaaagggtaaggggactctctgggacctttttaaatctttttataagggtactaatctcattcatgaagcctccacctttatgatccgatcaccttcctaaggccccaccccctagtgccatcaccttagcagttagactttcagcttaggaattttagggggacacaaatattcagaccatgaatatatgcattttctttctccatcattatgagtaaggatttcacgtacatattcaatgcagctttcatcaccccctaagcagaaaagctgcactgccacttcaaacctacaactaaatataatgtaatgagatccatgattgaaaacatacagaatcaaatctaggcctgctaaaggttatgagactagaaattcagagagccctattaataaagtaactttcgtggaaaccatcttccataggtacctgcttatttgtgaatattgtcatgaggttatatagtacttttccttctactttattgatgtgtgtggaggtagaaccatttctggagcaaagtttcacatacgtgacagtgaacttgtgggtttggtggtgggtcgtgctgatatgacatccttgtcatcacataaagacatgtatatttgtgtgcacacatcgaatatactgcaatggcatgtttctaagatgcacattctttcatatattttatttctaaagtcaggacatgtcttagaattgataatgtgttatagtgcatctggcagcattttcttctaatactacataaaataatagtgcaaagaacaactgatggtatcttggacgcaatgaaatgcattatgtagaaacatatcagaaggtgcattaataatgttaaagcaactccccaagaatattgaaattacaaagataacttatttgctaaagacacagattttggtgataaaacagatacagtctggtgagtaatttttcaaatgcttttcgcccatcttatgtgactcattagatcataaacttgtaaactcgatgtaaatcaccattgaggagacgtttcttatgtaatatttgggcagaatcataatgtttatgtaacattatgattaacaacagtgaattattattcagtgtaaatgaataaattttaactaaacataaaatcttggataattctataacattaatgttgagagaaattaatgtggtacaagactaaatatcaaataatataatttttaataaataactaaatctaaaacactttcaaatttaaaatttagcctgatctatatacctttttaaatcattgtatatttttagtgttaatgtgagaaaaatattcaaaatttttttttcaattgacatcttagctccaaaattaaaagagcatattttaatgggagctggtttaaaacaatttgacataagttagataacagtttggcaaatgtgtctgtgctcagttttgcttccaaatttggacttttagacttattgtcagcctcagaaagaaataagaagctgtgcagataattaaacatttgccttgggggaattatttgtagttaattaaaaccacacacttcgggtatatattgatacttgcttcactggttattaaatttgaatcatatgttaactacccaggtttctcacttgtccatcaaatgttgcttgtggcaggttcaagaaacaaactttctcataatattccaagccatattgtttaaagctatctcctaattttgagaggaaatgaatggagagaaacagagggagaaatgaaaaggaaacaaacaaagaatagtttattttagactccatctgattcagctctgttggggagttaaaactcaaccaagtgacacaaattcagtagagaacacatttgtaagtaatcaaggtgttgctgtaccacccccagctttctccatggtcacacgcttacaagattagcttatgacttttagatatctttggattgctttcctttcagcagcatgaaaaatatctactagactataagctccatgagggcagagatttggtgttttgtttcctgttggctccccaacatcaagtacagtgtctgggcaggtgtgatggctcacacctataatcccagcactttgggggtatgaggcaggaggatcctttgaggccaggagttcaagaccagtttgggcataattacaaaatcctgcctatacaaaaaattagaaaactaagtgggcatggtggcctgtgcctatggtcctagctactacagaggccagaacaggaggatcgcttgagcccaggagtttgaggttgcagcgagctacggttgcagcactgcatccagcctgggtaacagagcgagaatctgtctaaaaaagtgtctggcatatacttggccattattaaatgtttggaaaatgaatgagacctacttgctgtcttcctgttgatccattcacaggatcattccagtactttttaaagagcctccagggaggcctaaacatttagcaaggagccctttgtagttttgcaatagcccatagtcacagaatccttttagccatgttaaacatggatatgtttaaccatatcctataacaaaaaaagataagtgtacaacgattccatgtttaaatgtgctaagcgagggagggaatgaccttgcagagaccagaaggtctgcattccctctatgctattgttctactgttatggttcccgaggaagatgaacttaattaccactggatttcaaggttctgtatctgactttttcaaggactcaagactcccatatgtgagcaaccacagtaatggaagcattaagaacattaaaattagatagtcctttaatcttcttcattttgccttccttttatgtcctttcccatagttctaagactttccctgatgcaaaaagcctgcttttattttcttatttgttgcaaaaagacatcccagctagctacatctctacctttgtaagctttgagcagatatctcacatagtatggggggaaaaaaagcgcctatttattggcaaacatatgtatttgagtggttatttttaaaacgaataaattctatttttcctcaaacataaatctatcatgttagtgctgaaagctgctctgtttccaagttaaaaatgctgaccaaaggttttgcttgtttgttgttagattttgcaaaggatgaaaatattacaaaaggcggtgaagtgacagatcattctgtgcgtgaccaagatcatcccgatggtaggttgtgaaatcctttattagattttcttttcttctgctgggaaacagaaaaaaaaaaaaaaaaaaaacccacagacttgaatttttctggaaaaatattgaattccaataacactttattagcactgaataccagttgatcagtagctgccatctttagatgacacttttgctttccagaatcctcatcactcattacttttgtgccaggctggcttcatttattttgtttattgttacttgtctgaattctataagcactgggtttgcaaacactgagatgaatgtgttataacaatgagaataaatattttcattgaaaaacatggagaataaatgcaggggattaaatccacatagtcttgggatatcaagaagggagtacataacaaacagaaatgaaacaatctttagaaaaataacagaaaataatttcctaatgtaaaccagttcttccacccaaaacatgacagtacacattatatttataggcaaaggaaaaactcagaacagacatctgcatagcttcatggaatttctgaagataaatgataaagaaaggcttttcaagtgtagtcaaaatcaggtagtgattaaaaccaccagagtcagattagccttaaccttcttcttccacaaccctaaaagctagaagaaaatggagtcacagtttccagagctcaaaagggcacagtttccatagttaatgaagttattatttatacatgaaatcagagcaatattttctcaggaatacaaagattaagaaaacatgccacccaggtaccctttctgaataaactaacagaaggcctgagcaaaaacaataatatagaaaggaaggcaaaactcaagactgaggaaggcacattcgaaagggactatatggtaagagactaattaaatgtacaaaaatgttgaaataattgttctatcaaataattttgaaataacccttcataattaggatgaaaatgtcttacctaaatatatgtctttaactttgaaatttatagtatgtgttgtttgaaaatgagaaaaaagacagactagctttcaataatgaaagtctaaataatttagatcatttctactaccgaagacaactagacaaaaaatacatatatttatatattataaacatataatattatatattatgcgtatatatatatatatatatatatatatatatatatatatatacacacatatacatatggagagagagagagagactgtttaaaggcatcagtgagctaataagatactgaagaactgtaaagctgagctctgggaggcaatgaatctccagatatgtgagcccagaatttgaagctctttttaccttagggcatttgctgattctacagaaggtgtctggagctccattgctgaaaaaggcaatgaccccgataaactctctgttttggggttgaaaccccaaagatacgtaacctagcaggaagaatgaacgagcagtagattggcggtggactgcttcccagcttcaaatcatctcaatcctcacattaggttaagaccagtccagattgctagtcccctcaggcatctaagaaaagcaaatgtaaaatatttactaggagtgaaaaagagtgttacaggcttcaaatcatttatataaataatttgcaaaatataatgtccagcacacacataaaaaataccccaaaaaatgagggaaaaaaggtaacatgaaaaacaaaacaataaggcaagagaagttcatatgagctgaaaatattagttatgaacacaaagtattagataaatatgttgagtatgtataaggagataaagataagattggaaattttagccgagaactagaagttcaaaaccaattttacaatgaaagagtctagaagtaaatgatgctataactgaaattaagaattcaatgaatgaatttatgactgaacatcatattagacacagccgaaagaagatttgtgaactagaagttaggtcagaatatatccaaaattacagatagtaggggaagaaaggaaggcacacactgaagaaagaggaaaagatattaaggatcttatgataaagtctatcacaagtacagttggagtcccagaaaggaaggagagagacaattgggcagaagcaatagttgaagaaatgtggtgagaaatttcccacactgatgaaggacatcatgttccaaaagccctttgaactctaagcagaataaatataaataaataaataaatccacaaccaggcccatcatagtaaataaataaataatagaaataaatataaatattataaataatataaataaatccacaacatgacccatcatagtaaaattcctgaaaaccaaagataaacaaaacatctaaaaagctatcttcaagcacttggactgagagctgacttttcaatatgtataatgaaaataagaagataatacaacaaaatagctgtgaaccaagaattctaaacccagggggaaaagtatgtttcaagaattcaaggttaattaaggacattttagaccaaaaagaaaggcacagttcatcaccagagaattctggtgttctgcaagtagaaagctattaatcccagatagaaggccaaagataaaggaaggaattaagggcaaggtaaatggtagttactggataagtctagataaatattgatggtataaatcaatactgacaatgatgtcttgtggagttaagatatgcataacattaaaatataccacaataatggcatttattggaatgaggtaaattaattttaagtgttctaatgtttttccattaagatgaagagtaaaagtaccaattagtgttgaaactttgtaagtctcagtggcccctgagagtcaggaaatgaggtgagccctgtgattgcccagctggctgcctggagagtttccaggctgtggtacagagaggaggaacccagggagagcccagcaaactctccacgttgaggagacagaggtgagagtcctgggaggccaaggtagctaacgtttgcaaggtagcattctacagagaagagagctccacaaacggaatgctcagaggtctacagaaggaactcctcagtcttcaactgggtaggaacactagaaaagatctgagagagtgataactggagcttacatagggctagaagaagtgcctgttcccaccagcaagactggaaagcctcaacattcataaagaactctgaaggtttttgccttagtagcagagcaaaacaggcaatagactaaatgctcctcatgtcctccccagtagagcttaaaagtgagacttgaaaggatcagaatatttctgagtaacttaactgcattttagaatgaagctcaaaaatatttataaaaattataaatatatctcatacccaacaaagtaaaatcaacaaaattaccaggcatgcaaagaattattgcaagacaactctccatgcatctttcatatttctgcatgttttgtgagcagaggcactgcttgtatctttgaaaaggatcatgtttctcttcaaattaaagagcatacatacttattgtgcattttaaaaggttcagagaatcttgagattctctgatatggtttggctgtgtccccacccaaatctcatcttgaattgtagctcccataatccccacgtgttgtgggagggaccctgtaggaggtaattgaatcacaggggtgggcgttcccatgctgttctcatgatagtgaagaagtctcatgagatctgatcgttttataaaggggagtttccctgcacacactctcttgcctgccaccatgtaagacatgcggttgcacctcccttgccttctgctgtgattatgaggcctccctagccatgtggaactgtgagtccattaaacctctttttctttataaattacctagtcttgggtatttcttcatagcagcatgaaaatagactaatacattctctaagttcaagattcctcctctatgatatcacccactgagtgtgcaggaatcagctggtccacctatggcaccatgtgggaatcaggactcagagaacagacactaatactctggttactgtgatttctctgaataataaactgtcctttatctttgacccagaagtctttgtcttctgtcagcatccatggaactgtggctcaagcagggtaaaatctcagagtcttcatagttcttgacaggaagcaggaaagtatgatgcacaggaaaagaaaagttgataaatggaactcaacccataaatgatgcagatgatagaattaatatgaaagggcatgttaaaagttgttataactctgttccacatatttacaaaattaaaattaggactgaccatgttaattcgagacaaagaagttatagaaagacccaaattgaatttcaaggaattcaaaacacagtgcctgaattaaaaattatacttgatgagaacagtggcagattagatactatagaagaaaagattaatgaacttgaagatgaagcaatagaagctatccaaatgaaaacagaataagtgactgaggggaaaaaaaaagagcatccatgagctatgagacatcttgaagggtggttctaattacaatataaatgaatgtgaatctctgagggtgaatgtgggagaaagggacagaaaaaatatttgaagtaaaagtgattaaaatgtttcaatgtgatgaaattatcaacccacatatgcaagaagttctatgaccccaaagcataagaaacataatgaaaattacacctaagtacatcataatcaatttattcaacaccagcaataaagagaaaaatcacaaaaacaagcagaggaaaatgacaagttacatatagaagacaaagataaagataaatcaggccaggcacagtggcttacgccagtaatcccagcactttggaaggctgagttgggcagatcacttgaggtcaggagttcgagaccagcctggccaacatggtgaaaccccatctctactaaaaatacaaaaattagcaaggcacggtggtgggcacctgtaatcccagctacttgggaggctgagtcaggagaatcacttgaatccaggaggcagaggttgcaatgagcctcctgagctgagacagcaccattgcactccagcctgagtgacagagcaagactctgtcaaaaaagaaaaaaaaaagataaataaaaggtcccaatggaaactagaaactacaatgacatgcaaaaacatgatgaatctcacaaatgtaatattagagaaggtatgaaagcatatattatttattatataatctcatatatcaagttcaaaaagcaggaaaaaaattaacatttagaaaggcttgtttaggtgataaaatgataaagaagacctaggtactgatcactgtgacagtcagggttttgattaaactttggtgattggagaggagatactgccgggagggggccatgagagggctgcctggctggatggttatcataaaaatatatagtttctgtatttgcatttggttatttaattgatatctctatattttgtctgtgtttctatatatttgtcgcaattttataaaattgtctaaaagaggaagaaagaaaaagaggaaatgaggaagggaatgaagaaaggaggaaagaaaagaagcatcagtggcagaggttgtaaaactagattatagctagaagaaggaagagttgcacattagcctgactccataaataccactcaaaaactaaaaatcccagtgttatggattctgacaatatgttacctttcagaatatctctgaaaaattgtacaataatcacaaatagaattaaataataataaaattaaaagaagataccttactttctaaatttcccaaagagatcacatgacagtatactcagcaatgcaaataataacaataactagcagtgtaacaaaagcctcatgtatcaaataagatgacagaaacacaagcaaatgcttataacagtaagtgtaattaggttactttaataagtgtaaaagccactcagattgacttaaactcaataaaaaggtaaagctttaaaagtataaagttagaaaaatgtatatttgagaaaggagcatcaaaagaaaacatgaagaactacttctatttgaaccaatctattcggttagaagtctagcaaaaaaatctccagtgacaaagagttggttatttgatattgataacaatttaaattcctgatgaaatataatagtgatggggctttttgtgtcagatgatatggcaagatacaatacaaataaaaacctgttgaaaatgcaatgaggagttcccagatacaatattattagtcaatgacagaacaaatagactacggatgacatggactgtttgaaaaatgtacttagcagggtagtccttgctataggaatagacaggctgatcaatgaaacagatgaaagagttcagaaacagacccaagtagatctgggatttcagtacatattctggccgacatttcaaagacagatgactcaatcaatggcattaaaacaactagttggccatttgggaaaataaactgaatcccaacctcattcctttcaccaacataaattccagaaggagcagagatgaaacatagaaatgaaactataaaaatactagagtaaaagaaccaaaggttattattcagcactaaaaagaaatgagctatcaaaccatgaaaagacatgtaggaaacttaaatgcatattactaagtgcaaaaagccaatgtgaaaaggctacatattgtatgaatccaattatatgacattctggaaaggcaaaaccatggacacaatgaaaagatcagtggtggccaggagttgtgggggtggggagggatgaataggaggagtacagaggatctttagggcattgaaaatactctgtataatgcagtaatggtagatacatttcattatacattgccaaaacccatagaatgtacagttccaagagtgaaccttaatggaagttatagacttcagtaggagttacatgggatatctctgtaccatcctctcaattttgctgtaaacctaaaaccactctacaaaaatagtatttttaaaaaacaacaaaataaaacaattacaggctgtttttttaactgtgagcacatacttgcagacacaggatggtatgcatatgttatgaaatgcaggcatacacatatctgtaatgtgtgtgcatatgtcagtatattgcataaaagaggaaaataacaaaattgtaatagataaatgttgacataatgagtaaaggttatagtgaaattaaaaatgaaaactagtgggaaaatattctcacccaaatgacaacaaaagagctaatttttttatttgaaaaaaaagtgtgtgtgaaccagtaagaaaaaacataaacaatctaagagcaaaacggacaaaagactccattataattcacaaaagaagatatacagtcattataaatatgaagagatgccctatctctttattatataaataaatgcaaataaaatagtatcttctctttttgaactagataagattaagtggagttgaaagtacacaaaattagtggaaatagggtttccaaacacgctcgcataatattcgtgggagactgaaaggcataacctcctcatcagcaattttgggaaaacctaataaaaggtagaatgttcatactttgatggaaaaattatgcctcagagatttatcctaaactaacacccacccagagtatggagatatttatttactgaaatgttcattgcaatatgatgtttaatggcaaaaaaaaagtgtaaacacctgaaagctcacccataacgtggaatattatgtatcttttaaaaacaagatttccaaattaattgtaatgacagaggatgatgcttactaaaatatgaaataaaaaagcaggactcaaagtgtaaatatgttttgatcccaggatatatttacatatttttgcatatgtctgcatctgtgtgtgtatacacacatacaagagaaatatgacaactcacaatattaaaactggctatcccttagttataaaattatccacaattctcaatgcttatatgcatttttagcgtatccataaggaaattgcatttcttttgtaactacaaggcaaaaaataatttttaaaaataacttacaataggaaagtaagttttattggctctaagagaaaaccaaggatgtctagaagataatcaaattcacactaatctaggcttaacttttgttcttaatctgggatatttttagaaatttttataaaagtacagttttgaatattagcagcaatcaactttcaagtttaacaaaaagacacaatttacatgatttcttcaacacaagcatcaaagaaacagtctttgttcttaagaaaacttgagcatctaataatctgcaagcaataaaattatattgttgttgctattgttcagaaacagtccatttacaaagtgagttcaggtttatcccctagaaatgcttcattctagactgatgtccccagaccaatttttatgcaaattaattaaagctaaagcattagcttgagccaaacttaattaccaaggctccaagaaacaatcatgtgatctatttctaaagaaaagcgaatggatttttggattatctgttctaatggtcccctcccataagtatggctgattgagttcactgtatgaaaaatatatacataaactgtggaattctttgtgttcttttgtttcctcagccaggagggattagggcagaggacagtggggagaattcaactagtccgaatgtgaagagggaaacataaagcttgcccccatggggccaagaaagcaggatggaatgtgaaaggtctgcatgcactgaggagaaaggcagatgggctggaagccctgggaggagtcattaacacacagcaggcctgggtgcggtgcaaggcagtcaggcataccttgtctttgtgcaatacgccaaagcctgcctcgttttcaaagctggacaccttgttttgtttcttcccccatttttaattaactttatttaagaaaaatgagaaaaaaaattctatttcaagaaaagattgtcaaaatatgtaaagcacacaggtgaaacagatcaagagtagagacaggtttagagggcaaggaagagaaatattccaagagatatttgaaatagcactttatcctcaaagtgaagggtcaagccttacaagtcacagaaactccctggtgttcatcaacagactcaggttgccacctcaagcaggcccaccttttcagcagtgccccaggctctattaaatggggacctgctcattcttgattgaattcctctgaaaatttatcaagtggagcactgggaccaggggacacacaggaatacagattttggccttttcccctctctggatgctctactctttcccttcatgatatagacgaagccagatcacaaatagtacgttaaaggtccttgcaatgacctggtgcgatgattaggttcaatggccagttccctatagcaacagtgatagagaatgaagctcactcagtaaacaaacagtgaaggttccctctcagtatcatccacccaataaacaaacgtcaatgtgactggaaacttcatctgaagacatagctatgaacctaggagattatctcgttccacagccttttttcttttcaatagatgatgaaattaaaggtcaaagaggttgtgatttgcctaaaacatccagttatctttattcccattccagggttctctgcaacaaatataatgtgtggagtgcttagtagcatacaagactttaccttgttgttaaaggatgcaagagaaagtaagttatagtccttaataactatttacagaccttgatgagtactctaatacaggtccaattaaatagacattgattgatgacttcttattaaatgggtgctgggcaggaaaatatgaataaaacaaaatttctctcttaatctggtaagagagacaaagacagacacaactacatcacggtgtgatcaggatctggatggtaattaggaaaattcatgtgtatatatctaaagagtcataaagatatacacttaaggtttgtacattttactatatgcaagtagatctcaattttaaaagctaaaaagcaaaataaagacatttccaggcaaaacaaaaagaaaagagggattgtagtcaggtagagctggttatgattcttgaaagcagaactgagatcacagcacttactttccagaggtaatgtgatgattagagattacgtgtgaagtatctagggacagtctggcatttttatgggatcaataatttgcagattcacttacatcttctaggccagtgcttctcaaggtttaacttgcatgcaaatcacatggacatcttgttatacaatgcaggctctgattctgtaggtctgtgatgaggcctgaaattctgcatttttgaaaagctcccaggtaattccagtgttgcttgtccatggaccatacttttgttagggacaagctgccccaggaccacccccctccccaaaaacaatgcagctgacccttactccgaatattctgcagctgcattcctggacccttatctaggcactacagcaaggtcgccagacttgcttacagccctccgggtggcatgggggaggtcatgagaaacgtggataaacctaagttacaccctcttgtaaattcctatattgtaagctggtcacgagatgatatgtggtaaagttaaccgacaaagaaccccagggtctctctccaccatataaacccctcattttgtaagttcagggctgcctccgctgactgtggtggagcagcccagcaggctaataaacttactcgcctgaccttgggtctctctctctctctctctctctctctctctctcgttctttctctcagctaaccttacaactttgagtggcaatggggaagaatgaggatgaatgggttttttcaaaagtggaaaggtcttgatcaagttcaaattttaaaaggcctttctgctatcaaatcacaaaatagaatataggagaagaaaatgaaagatccaagagacagatgatatatccctaaatgaggaaagaaggcaggagactagaaagtgggaaaaccgaaatattttgcagaaccataaagatggcatttcattaaacgtcaggagtgatggaagaaaataatcaaaaacagcttgaggtttttatattcaatgatcaaatagataaacatgctttagttttaattattttattggatccttttgattaaaattgagctcaggaggagtggatatcacacaaaaaacataatttttcccttatccaggtcatgctagcagagaatgaatcaaggggaagtagtatcatgggcagtttaaaaataattgtatcagagaggaaactgtaagatgaggggttatataagtcagctttgctgcagtaacaaataaccccaacagtttcactgggggctcaacaacaaaggctggttgtgtctctacttagcccgggttggctgtgttccacatgctttccattcaggatctagacgaaggaacatggtttattaggagcaaaagagctgcaggcaacatacaatggatcttaaggcttctgcttggttgcagtacacatgatgtctgttccagtgccatttctaaacaagtcacatgaacaggcctgtgtcaatgtggtgggaacatacacttgtcccacaagggctgctgcgtgtcacattgtcacagacagggaaatataatcctcttttaggacgaagtagagacaagttgaaaccataatgccaccacagggatggactcaggcaaagagtccaagctcctctgaatctgctttgcacctataaccaaccctagctctagaatgttttttaaaaaattccatagttaagtatcctcagcacaaaatctttcattagcccgaggcaaaatggccagatttcaatttcctctcttaatgagcacttaaatgttttaaatgctacaggggagggtaggaggagaagccaaggggtgtggaagaaaaaccattactagataatcaacctaaaagtaatcaagagttggctgaattctctcctgacctttgctgtatttagtatgtgtcctaagagaatggttgagctgtagcaggacgagccgcagacaaaacttctcagacaccaagttgtagaaggaagggctttattcagctgggagcatcgacaagctactgccttaaaatccgagctccccgaatgcacaatttctgtcccttttaagggctcacaacactaaagatttcacatgaaagggtcgtgattgatttgagcaagcagggggtacgtggcaggggctgcatgcaccggtggtcagagtgaaacagaacagggcagagagtttcacaatagtcttctatacaatgtctggaatctatgaataacatcggtttctaagttatgagttgatttttaactactgggtttaggccaggcaggcccaggcctggtttcgggcctggtgcagggctgcctgtctttgattttacttccttgtttttttcttaaaacaggtactgagtataaaacaatataaagcgatatgggagggtctctctcttccctcatttcccccttttgagactctcactttttcttagtgggagttctcactcttatttttgctacttattttttttgttcaatagattgatagtgattcatatagtacacttgtgctgaagcattttggtgaactaaggtagcgatgaagattttttatcatttaaagaagcacaggtagcaaacaagggagcagtaagcaggtttttattactattataactcctattataagagttttaagtcctcttagtgctgggaaccaccttctaaacatggctttagggttgaatctgtgctacacttgtacaggcacatgtgtcagttttgtcatatttttaactatgtctttaactacttgcctttgattatctatgtgtagacagtaattagtaaggttaaatttcttatagacttctcttttagctgctagcaagtacttgagagctaatccattttgatagatagcatttcttatctgagttttttgccgggccagaatagtaaaggcttgaccggttttattagtgatgatttctaaaacagcttgcaaccgtatgactctgttgagcaggtaaatgggggtccagtattcctatgagccatcttgtgtctaagtggcaggcctatagtattgtataattttgtttttagtgggccatttatcatctttttaattacttatggctatgcttcgttttccgcaggaagcatagacagggaatgcctaggagttcgcctgtttttatgggcagtaaaaagaaagatggtttaatggtgccaataacacaactacctgtccactggtcaggcagcttagcgtaggctctatgtctacatatccagtataacctggtagggtcaggctagtcctggtggaattctgggtgggcctagacagtctgcaaccttggaaatttactgaatagatctctttctgtgtaattggaactccaccatgtaactgttttttgcggtatcgttatacagtttttgctttagacaactaagtcatcttacagaatgagtgaattcttttcctgtttttgttgttgttgttgttgttgtttagctatgcaataattgagacttttagaacttagaaatgatcagggtgattcttttgggctgagaatccatcaggaactgggtctgtaggcactaattctcgggcttcttatggccattgatctcttattacagtttttctacaaacataacatgaagtgatatttagagactgggttacatgcccagctaattgcaaaaaacaaatttttagtctttcctggaatcttaggtactggcacatttagttcatcctagaaagtctgaaatactggttctggagagcgtctttgaacctcctttcttattaggctgtttatgctagggtctagtctttttctatcaatgcctaatgatacatattgtttttttaattttattttgggtctgaggggtttgtgatgactaattctaaagggttacagttctcactcgtgcaggaggggctgacttttcttttttgaagcctaacaggatctttttaatcttctgttcaagtagcctaaatgacacaagaccagtattgacacattttacataaatatgattcttgacagacatactttttttttttgctgtgtaattttttttccctcatcagagaaccgcatcttattctatgctgcttactatcaatagcagcacaagcgtcaaattttaaggttacatttttggggacctctctttcttctgttctagctattactttacttgtgtcacctagaaaaggactagtccttaatcttactttaaagactgtgatcatggggggttcagaggggtcatagcacacatcgggcaggtcacttcctggattacatactttgtgctgagtgttattgtacaaacaagttctttttggagttcctaggcatttataataactataaaataataggactgtagcaatcttttgtctcacttcagtgatttgatgtatatactgggaacagttctcagtctgaggaaggtcagttgaagtctttactgtacaagtctaaattttaaggaaaatgagtcctgcaatgagtttcttcatgcttcggccatgtgtggaccagtcagcttctgagtgtgactggagcggggcttgtcgtctttttcagagtcactttgcaggggtgggtgaagctgctcctatccacgtacagctcctagtctactgatgtttaagggtggtcttggaggttgggcctactagagtaaactgagtctaacacctctacacagtttatgttaaactgggctctctgataccaggagtaaggtggcggggttagggtgttgcaaacttcaatggttatgtagggatttttacagagcaagatttggtatctagttagtctagcattcattagctaatggtgtcctttggtatttattaaaatcaccacagcatggcaggactttatgtttaggttttgcctaagagttagcttatctgcttcttgtgctaacagggccgttgctaccagggcgcttggacgtgggggccatttggaaacctcgtctagttgttttgagagataggccactggccttggccagggccttacagtctgggttaaaacttcaactgccattttttctctttctgacatatagagtgtaaagagttttgtcaggtcaggtagcctcagggctggggccaacatgagtttttctttttaactcatgaaaagctcgttgctgttggttgtaatagatgtagtttatctaatctacatttttattgactgtcatctactaaaatattgacttaaatcctgtaactatttgatttcaagctttaaattgatctggtattccttgtggggctccaattgcatctaaatagatgtgagagttgaaagacctataaggggcttctctggctttacgatgtcttattttttgtttttcctctggttgatgaaatgccagggtgaaagggatagccaaatggactaaagcacaagtgccactctagttattcagcagagtgcccagtaaaggtccaccacaataccaccacacatctgcttggggatgaacaacggctgactgattgataagctcttgaaaattcttaagcttactgcatcccttcaggtctccaaggaatgctaagtctcctccttgctgtgagagacacaaagtgaacttagtgttgggagacagaagctggatggacctcaggtgctgatctgcagggactttgggatatagcagagagagcttggcatgatttattactccaggctgtagaatctcagaaaagagctaccacgcagcctacgcctggtcgactggaggaccaccttagtggaagggggacaattagggcctctggcctgccatgtgcacaatcataacaattgcttttgtttaatgtgcagatggaatatttgatccatttcaaccaggcatttgcattcttggtatgctgtcttaattgccaaagtttgttttaagtctttaacttctatgatcctttagtaaaatgaatgtttcctttaacacctatttttattagtttttagactaaagaaagctaaatactattttatatttaataatgtttcttgtatgatttttatagtagataagttaaattttacttttatattagtgtgttattaatgttaaacttaattttaataaaaccttgtagacatatttatctaattttttatgtttgaccataaggtaagattttatagactttttttaactttttataatttttgttaaagagcaggttgatgctttaagaaaaacctgttgcatttttactttaatgtccagttcacagaaaaactgggtgatatctttttaactttagctaatatgtttacacacagaattttctttacaattaacgttttaaaacttgcttaaatttttaaaacaataatttttttaacttttaatgtaggtaaaaatccacatttttatgtccctttataatttttttactaaaggtatattttacttttcttatacaccttgcacataaactgtttctttaatggtactcaggaggccttattacttttaaattatacaacattttttgcataaatttttttataacattttttctttcacgacttttgcagacaatttttcaacatgtcttaactttttgacttattacatttttttctttaaacaactagttaatttatttcaggacaagaatttactatataacactctttttacataaattttgcctcccccccccgcccttctcttttttaaagcgaactttctttatgtctttggactagactgtctaaggccacaagattagaagttactataatacatgttacactgttaacttttagcaaacttcacttttgttgaaaaccttgtaagtttgggatttcaattatcctttgctattaataagatcttgtttagtctgaattaacttagaattggtatagatggcctctttttctctctgctggtctttccttgcctctgccagccacttatgctgctgttctcttaactgctgttggggggaagggggtctaaaactagctgtaactgtctatgtacggaaactggcctgggtgccttggcttacaggttaccttgtgccatacttttgaaacaagggacctgtccaggcttccttctgatggccaacctacctctaatgctggccagtctatttcacacaaagttctaagttttcctggtgtcacagtaacaccgtaatctcctttaaattctttcttgaaattttttaacatagttcctagtagggtgggcttacttacaccggacctgtttttgtttttgttttttctcctgagacaaaataccatgctcacaccacacacactcaccacaagacaaagaacgggtatggagggcacacacacacttttaccatttatagtaagccaaaatcacgaaattcaaaatccgagttccaaaagattcaagacaagtcaaaaccaaaaccaaagtatctagcaattcaagtcaagtcaaaaccagaacaaaagtgccaatgcaggcacactgtgggtgatcaggccactcttccactcagatggagtggggcaagttccaaagactagtcttaccaagtttcagatgtccggactccaagtgccagttccttcccagtgttcagccactgtgttaatcctccacgggggcctgctatgcgctgctctggcaaggcgttccactggggcaatttcctacccgggagtgctctttggatcctgtcactcaggctggccggagtcccccgcaggatgctccacagggcaggcctaagccgcctaaggggctgcctcggctgtccatcagttacctcgtttccccgtcagggaaccaagaaacgtagcaggattagccgcagacaaaacttctcagacaccgagttgtagaaggaagggctttattcagctgggagcatcggcaagctactgccttaaaatccgagctccccaaatgcacaatttctgtcccttttaagggctcacagcactaaagatttcacatgaaagggtcgtgattgatttgagcaagcagggggtacgtgacaggggctgcatgcgccggtggtcagagtgaaacagaacagggcagagagtttcacaatagtcttctatacaatgtctggaatctatgaataacatcggtttctaagttatgagttgatttttaactactgggtttaggccaggcaggcccaggcctggtttcggggctggtgccgggctgcctgtctttggttttacttccttgtttttctctcaaaacaggtaccgagtataaaacaatataaagcgatacgggagggtctctctcttccctcagagctgttatccccccagttcccttgtgcccacattactcaagttttttatgctctgttgatggaaaaatgaaagtgcaagtagtgttttcattttctaggaatcctcactatgggaaatatttgtatcttaaaaggaaattaaatgtagttaacccatacagcccagaaattattgtaaaatttgaaaatttccaggttgtgtcctctatccatatcctgtgcattcataagctaagtaagtatgccaattttgcatcagtttccaaaaaaaagatttttttcctaaattatcaggatatttctcagaaaataattgatataaatctgatgattagaaaaattgtatctttgccctttggtttcaaaactgttctctatctctccatgcatgattaaagcacggtttctgaaggtcaggaataaagctacggtcatgcatatcacatttcttttatttttcaatcactgttttgaacaggacaagagaatgattcaacgaagaatgaaataaaaattgaaacagaatcgcagagctcatatatggaaacagaaggtactgaaaccaaaatatattgttatcagagaatgagatgaaactgtgaatcatgacttctatatatacctgtgtgtgtgcgtggtgtgtgtgtgtgttttaggcaatgattactggaggatagcaatagtgttcaacttggtgtacctattgaaacttgaagggggaaaaaagaactctaactttctataccatagtcacagtattctctcaatgattccaactaaaacaaccctgagtgtccatctgtctcattctatttagaactttcatcaaaccaagaagatgccgtgattgtggagcaaccagaagtgattccattaacagaggaccaagaagaaaaagaaggtgaaaaaggtaggactgctcttaaattaacccatcaagaatggagagtttctttggattcctgcctagaattcaaccatcaaagttattctcatgcaattacagtttgtaaagggggaaaacgaacatttccttaaccccaaatctccgtttgaaagtagagtaaaatctagaagtagcaaaagaaaatactcggaagacttatagcaattacatatagcataaagatgtttttgttattcatttagattcaatttaaatttttaaaattacagtattgagaaagcctataagaaatcaaaactatggactagagggataaagttcatacaaaatctgaaatggctttagagcaaatagactggcctttttgtattgatttcatctgtcttccttagtatagtagtgatgaaagaaacaatttatgtaaaatatgcatgttatatgaacctaaattgcaatcttgcttgctaatattaggatgcaatcatattgaatactgttttaaaaaaagtgagcattataatgatttctgaaaactcaagaggaatgaacactccttaaatattaaagcagcatttggggcaaaaagccaatgtattggagtgaagatagaaatatttttaaaaatgtgtttaaaaaaactattctggttaatttagtgttaactgaagaacttaaagaattcaatttttaaatataaagcaatctcttaaaagaagctaataaaataatttttgttacagtatatcataaatcatactgctcttaaataaatatgtatttgcaaagcagttgcagagtaataacttgacaggccttgtttatagaacacagtgatcaattttgtttccaaattaaaactcagacatgatctcaattgtaaaatcaggtcaatagcaactacagcttccaaattatgaactcttcttggcaggggcattgacagtttaattgctaaaccatgttagagattttgacacttttaaaatgttgactgcatttacagtacaatattcttccatgtctatgcctctaataagcttttcgctattgcaaatcctagttcagactcacgactccactttcctgttaagtcaaataaagggtatattcaaagttatttcatgtctaatattgataactgagaattgaaacaacccttactcagaatcagatatatggtattgctctcctcaattgtagtttaaaaatgtgaaatagacaatgctgtgcgtgttagcttaatttctctgtagcagaaattgttggctctgtttattgcatttcaagaaatgcaaatggtaaagaggaaaatcaaacagctgtacgttttcctcttttgacttgacctataagaaaaaagctggcattcggcacattgacatgtttcccttctcccagagccttcccaagcattgaacactactctgatgactgaagaattaaatatccacctttcctctcttccttgtaaatatgccaatctttttctgataatggtggaatagcatgtgggaaaaaagcaaggtgaaattctgctacttgcttttagcaacgatgaggttgaatttctttattaaaatttgacttttcactgtaagatgactaatgctggtagtcttgaattaaccacattttctcttcccatctttatcatagatatttcacttggtcctgccttgaatatttctggtgtttaaatttgaaataattttaagtgcatcacatttgtcatcttatactttgcatccaagtgaaaagtactcataggaaaaggaggcaatgtagattcatggtgctctgcagtagctctgctccaccattgacaagctgggtgactttggacaagttacttaacctatctgcttcaggttcttcatctgtaagatgatgatggcaaaagtacctgtcacatatagttatggtgcaaatttaataagtaaaacgtgcaaagcaattaaaacaatgcatgacacatagaatgcactccataagtatttagtatttatcataatttgatacattgatgacaaagtcaagaaaatccacatgtgatttccccaagtccatttatcattcttcttcactattttgaatctgtagaaagtcacatattttacattatccttcaacaacaacaactggttctatccatttggttggcagcaccatctcaggccagcagttttgatatggtctaaactctttacattgctgcgtattttattctaaagagataaaacaactaatagaaggaagccaggtggaaggcatttctctccattcataaacacttccttgtttgtcagtatctcaatcttccatttgagaaataaacacaaccataacttctatttttttaaaaaagaaaccattgagctgttgatagatccacaaaagaaaactagtaaataaattcaaagtagcaattttttttactttctttttatttagttattaaaaagtcttgtttgaaaacatttcgaggctatagctccagattttgtattcacaaaatagtgtcttaatggaaagttgtacatatgtattaggaattatctgtaaacaaaacaaatgagtattttattacatttgtaaagatattctttatagctttagaagtattccttctcttttattttaagactccttttaaggaggcagaaagtgattcctttaaaaaaaaaaaaatccagaccaggaaaaatatataacctttttctctcttttttgtagcattttataagattagaaaatgtagataatcttcaggatacatcttctatggctcccaggtatatgggcacagatgttgcaacattaagttttgaagttagttctattaaaatatggattttgaaaagaaggaaaaatattcagcagaagttcatgctgataaaattacacaatagcacagtggacatgtccctgggagacctgaaatacaaaaatttcaacaggcagaaagtgaggtttcacatatggcagcttttctgatatagccacgttgcctcttcctaaatgagcccagttttatgatttcccagcaggacctgcaacacatatgaaatccagtcgaataacgtcatttaggttaataaccaaataggaaagtaatattatagaagatctcctctgaaaaggatctcatgttttagtataaaatataaagtcagcattaaaacatctttcttacatttgttatttgggcaaatttagaaatatttgacataaaatcttaactatatcaacatcgagttattatttcacaaaattttcatatatgttttattatgatatatattggatatttttttctctaagtgttaaacagaatgaatacatttggtcccaataatttttcatatcaattaataagtgtagtgtggaatagtaatcctttgtctgtttacctaagattgagcaaaatgttgacagagacttaaagtatactatggtttaatgttttcttagaaaaagatgcatatgggcaggcatgcaagtaaagagttaagtgcaagccagtgacaagtgtaaagtatcatgcccttaggttcatgttttgaaccaagcatggtctgaccagcatgaccttgagacatagtgtacagacagccatggcttctagccctgcctgtgtgattcctggcaatccttaaacttcgaagaatcccagtctctagggtaataatgaggggcatgaactcaaaattgcaattataaggttctccagttttataaattttcttagaaggccaactctgaagaaccacattcttggtgaaacaagagcgatggcatgggagccaatggtcagccatgctgaaagctgaaatcataggttttcctcagttttagttattgtaccctattgataaaaatatagaggtgccctaggccaggcaaaaaaaaatcagccaaatatattaggacttaccaatgattggacagctaattattccctaaagatactttaaagggggaggggaatgccttttagctcaaggtgggtttacacagaaactctgctcagaaccaagctggatttccatcaccatctttcttagtccatgtgggaaacatctttttttgcaactcctctggctacgatttcatcttttagtgaacacatagcaagtgagggactttctcttctgcttctaccaatcaaatccattagaggtttatctcatctacaaagcacccctgtatagcccttggtgttttccatttctcataggattcttacatcactggcagagccctttcttctctccttgaaaagcagagcttgcactagcagtgttgccatacacagaatacctgtgtattacacaatagcacagtggacatgtccctgggaatagaatacctaacacttgggccatcatatacagactgtgttcttggctataaagaatcattgctcaggcatatttttgattcatgcaaaatactatatacacttgcatgttgagtaacaaacttactggaacattctaccttcagaaagtctttgtatctcttttcaaatgaagtcaagtttagtaatactatattattcatattagcagcacaatcatttagttttctagggcagttttaccatttgttttcttcttttttaataatattttgaatctgaaattcaacaaccaaaattatgttttaggatatcagttaaattaaaaatgctggtctctgtttgggttttatgaatattttagtatctaatgaaattcctcatattggttaagtaccttgaacataaaaattataaagttttaagctaaattgtttaggttttctacatgtctctatgtatgcaatgtaaacatatagaaccagttcattcaaattatgctgcataactgacctataattttaaagttaaaaaacatagaagaataaaaggtatattcactgcactttgtcttgcactttgatttcttgctacaataatgatgttggtgtggatagcatatatgcatgtgtatatgcgtaaagttagattatacgtgtataaagttcacatgtatctacccagtaagaaagttatgcaggcctcttgagtttgttcaaatcctctagcttgctgcaatcatcttgtctttaaagatttagaaaaaaattgccctgaaactccatttttcatgttaggagaaatctatcattccttccaatatctctgagaattctttggtgtcaggtttatttcttctaatctcaggctccaagctcctgcctctggttctcacttcagcctttgccattccttttttcgtaagctgtctctagttctcactatggctcccactcagacaccaccaccacctctcatcccttcactccgtgcagtaccacaaactcaaggatgtgtgtaggtttaagtgaatgttagggtcaatacttgtaattaacttgtgcttgcccatctggggaattttaagagaccatctcttctaagtctccagcatccggctacatcctgtatcgccctttgtcttctttgatttcttgcacttcctaacactccagtttcatttacagtttaactttgtatcatgcctgtgtccttctggtcttgccctgaggtgtatgattctacaaccatgtggcttatcaaaccacgtggtttatcaaaataatttgcagaaacaaaagatgactcacataagtggaattctgtctttaaatattgagctttttactcctctctgccgaattagagttctacaactcaactctctgtgcataaagtacctgaatttttttcacaactaataaaaagattaatgtgtaccttcatctaaacataatattgttttacatatatgatcctgaaatacttcagaaaattaaccttctctaaagatagtgagtataattattaacatttgttccttatatttaacttccttccaaagacattatataatgctaaattgaaattttcagaaagataaaattatggctgtcatacaactataaaatcaatacaagtaaaatattttatttaaatgattaactagtaagggaatcattaagatgttaaaactggttcaaaggagaatttgaagagtgtgtgtgtgtgtgtgtgtgtgtgtgtgtgtgtgtataaaatccatctatcatctatacagtgacattttagtcaacaacagatcgtatatgtcccggtggtcccataagattatgatgctacatttttactgtaccttttctatgtttagttatgttttgacatacaaatacttaccattgtattataattatctacagtcttcagcacagtaacatgctgtatgggtttataacctaagagcaatagactacaccatataaccttggtatgtagtaggctataccatcgaggtttgtgtaagtacactctatgatgtttgcatcatgaaatcacctagcaacatatttctcagaatgtatcttcaccttaagcaatacatcactgtatattgattaggaattatggctatatggatatacacatggatccataatacacacacattcagaaacactgaatatatccatacaatcacacacaattcaggagcactgaaaatttccaaactggctaatatcatacaggacaatacaacatatcctttccttctatcagacaaaattcgttttcactgatatgaacaaatctcattttcattactacaagttttctacatgttaccttctacctgtacagatgtgtaaaatagtctagtgaatagaaagctggtcaaaggaatacaccctcatagaaccagataatcccacagagggattatctggagggtgacacccaaccttccaccccagtgacacccagggatctcttttatccattgtcaagtcttagacaatttttcttgacagtatactgaaggcaaaactgccctttttttaacctgtttaccacctcacttatttgttattgttcactatttgatacatttgatagacagtgataaaatactagggtagtatcagagtagggcagtagcttccaacttcatctgaggttgtagtttacttgctattgttttatggcaagtactgctattctacattttatatagttgtacacacactgtagatgaagttgtacttctaagatgcctcagttgtgagatgtgccattattttacatattattaataaattttctaaaatctggcttattaaagtaagacacaataattttgtatcatttaggatttttattttatgtgtttaaaaaaactcttcgaacaagatgtagaacgttttcatatatcactcttgagaatacataaaaagaaaatgttaggctaaaggaattagttatgatactgctaaaacttcatcaggttcagggtcctacttctaaatcactttcagtcaaagtcatcaatatctgtttttattacacaatattgtcctctgccaatgtctttgatggttcagaacttaagagaattcataaagaatttaaaactcattggcttgtaagtctcttaagacttaagtctgtcttgctatcatatagagagttagcctattttttcttttttgcttctacttagaggcagttaaaacactcctgactcaccacctccctccatatttattatttttcagagattttcacctaagtcattgaaactcattctgcaagtttgagtacttttggttttgatgctaatgcatatatgggtatgataaattgtatcatcgtgtcctgaccaacaaaaattttgtaacaattcactgtttcaaagatgttaagatgtgaaagcagtgtactttatattaggaaatatagtattatttatttcacagtgaaaactactacactgagactagaaaatggaaacttgattacaagtgatataattgagtatatttgatatactcaattgatatataattgagttattttttttctactaactctaatgactagcagtgggatccttactagcacatcagtgcaccctactgcacattgtataactaagaaagtcataaatggttttattcatacattccacaaatgcttttaatgcacatgtaatatgtgccagaaattatatagacactatcactgaaactgaggaaaacagacaaagccactgctgggctcatcccaagcatagagctcaggatgtaagtctttttttttttttaactttttattttattattattattttttttggagatggagtctcgctctgtcacccaggctggagtgcagtggcgcgatctgggctcactgcaagctccgcctcccaggttcacgccattctcctgcctcagcctcctgagtagctgggactacaggcgcccgccaccgtgcccggctaatttttttgtatttttagtagagacagggtttcaccgtgttagccaggatggtctcgatctcctgacctcatgatctgcctgcctcggcctcccaaagtgctgggattacaggcatgagccactatgcccggccttttttttttttttttttttaactttttaagattcctcatataaatgagatcacacagtgtttgtctgtgtcttatttcactcagcataatgccctcaagtttcatccatgttgtcacaaatggcaggatttccttctttttatggctgagtaatattccattatacatatatattccattgtatacatattatgtatacaaatgtgaggtgtgtgtgtgtgtgtgtgtatgtgtgtgtcacatttttctctatttatgcatctatgggcacttaggttgtttctgtgtcctggatattatgaataatgctgcaatgaacacgagagtgcagacatcaagctactgatttctcttccttcagatatgtaaccagaagtgggatggctggatcatttggtaattctatttttaattttttgtggaatctcatactattttccataatgctgtactaatttacatttccattaacagtgtaaaaggttcccttttttccacaccctcaccaacacttgttagttctttcttgcctttttaatgaaactctccctaacaagtgtaaggtcatatctcattgtgattttgatttccaattccctgatgattagtaatgttcagcaccttatctcatatctattgcccatttataagtcttctttggaaaaatgtctactgaggtctcggtatcaacataatgctggccccataaaatgaatttggaagtcttcccttctcttcagtttttttgaaagagtttgagtaagattgtcattaattcttctttaaatgtttggtataattcaccagtgaattaacctggtcctgggcttttctttgttgagaggtttttgattactgactcaaactcttcattgatttttggtttaatcagattttcttttttaaatcaggtaatctgttttattataattcttatatgtttaggatactaaccccttatcatataaatggtttacaaatattttctcccattttatatgttgccttttcaccttgttgattatttccttttctgtttagaagctttttagtttaatgaatatctgtttatttatttttgcttttttcacttgtgcttttgatgtcatgtccaaaaaatcattaccaagaccaacattgagaagttttttcctatgtcttttatgtgagttttatggtttcaggtcttacatttaagtttttaatctatttcaagttaatttctgtgagtggtataagacagaagtataattttattcttttctatgtgggtatccagttttcccagcatcagttatgaaagagactatcctttcactgttgtgtgttcttgacatccttgtcaagtattaattgactttatatgcatgggtttatttccgggattctcaattctgttctattggtctgtgtgtctgttgttgtgccagtaccatactgttttgattactatagctttgaaatgtagtttgaaatcagtaagtgtgatgtctctggcttttttcctctttctcaagattgctttgactatttgggatattttgtgtttccatatgagtgttaggattgttttctttttttatgtgaaaaatgcccttgaaattgtgatagggattacgttgaatgtatagatcgatttaggtatttgggcattttaacaacattaattcttttgattcataagtatggaatatctttacatttatttgtgtcttattcaattttcccatcaatattttacagttttcagtgtacagatttttcactgccttggttatatatattcctaagtattttattatttctgatgctactataaatggatagttttctttatttgattttcagatattcattgctagtgtatagaaatgcacctgatttttctgttgatttcgaattcggcaagtttaatgaatttattagttttaacagttttttgttggtgtctgtaaggtttttaataagactatgtcatctataaacagagaaaatcataattcttcctttctgatttgaatggcttttatttctttttcttgcttaattgctttgtttaggacttctagttctatgttgcatagaagtggtgagtaggggcatctttgtcttgttcttgaccttagaggaaaagccttcagctttttaccattgagtatgatgacagctgtgggcttgtcatatatggcctttattatgttggagtacattcctcttacactcaaattgttgagtgttttttttcctaatcatgaaagaatggttaattttgtcagatgctttttctgcatatattcagatgatcataagattttcatccttcattttgttaatgtggtatatcagatttattgatttccatatgttgaaccatccttgaattccaggtgtaaatccctccatccttctaaactgctgttgaatttgctagtaatttgttgaaatgttttctatctattttcatcaagggtattggcctttaatttttatttcttgtagtgtttctatctagctttggtatcaaggtaatgctggcctcataaaatgaatttggaaatgttcccttctcttcaatttgtttggaagagtttaggtaaaattggcattaattcttctttaaatgtttggtagaattcaccaatgaagtaatctggttgtgggcttttctttattgggaggttttcgattactattttgatctctttactcattactagtctattcagatattctgtttcttcgtgattcagccatgttagattgtatgcttctagcaatttattcatttcttttatgttatcccatttgttggcatataattgttcatagcagtctcttatgaacccttgtatttctttggcatcacttgtgacatcactgtttcatttatagttttatttatttgagttctctcttttttttttttttttttgagacggagtcttgctctgtcccccaggctggagtgcagtggtgtgatcttggctcactgcaagctccgcctcctgggttcatgccattctcctgcctcagcctcccaagtggctgggactacaggcacccgccaccaagcctggctaattttttgtatttttagtacagatagggtttcaccgtgttagccaggatggtctcaacctcctgatctcgtgatctgcccgtctcggcctcccaaagtgctgggattacaggcatgagccaccacacccagctgagtcctcttttttctttagtcagctaaaagtttgtaaattttgttaattttttttaaaaacctcatttttgttcatcctttttattgtttttctattctctatttcattagagatcagagatttcatgagagattagagatttcagtcctaaatttttaccatttttttcttctactaatttgggctttatttcttttttagttccttaaagtgtaaagttaggctatttgatatctttttttcttaatgtaggcattcataactataaactttctttttagaactgcttttgctgcatcttgtaagttttgttatatggtgtttccatttttgtttgtctcaagattctttcaattttgtgatttcttttttgacctattggttgttcaggactgtgttatttaatttccatatatttgtgaattttccaaaattcttcctgttattgttttttagttttatatgtttgtgatgagaaaaaatacttgacatgatttcaatgaacttaagatttgctttatggcctaacatatgatctatcctagggaatgttctgtgtgcgcttgaaaagaatatgtattttgcagttattgaatggaatgttaggtgtctgttaggttcattcactctataatgttgttcaaatctgttgtttctttattgattttctttctgggtgacctatctatcattgaagtggagtattaaagtcccctactattattgtattgctatttatttctcctctcaattctattagtatttgctttatatatttagatgctctgatgtttggtggataaatacatacaattgtacatcttcttgataaattgattcctttattattacaatgaccttttctagtctcttgtgactattttttagttaaggtctattttgtctagtgtaagtatagccaccttgctctcttctggcagcccaagctgtcaataaaagctagaatggtggtgcagaattattaaagtagaagtgatagggtgaaaacccagggttagaatgagagcatgcatagcctttctggccatgccacggagtgtggagactcactgccaactagaatgcagacaaatgatttgattcatcattgattcctttgttttccacgtcattttacagactaaagtcagtaagaacccaaaattattacagttatcgcactctgtcagcctttggtattgaattcatatgggattatatgaaataaataaagttttcttagaacatgcaaaaaatctagaacatttactacctggccctttatagaaaaatactgctgagccccagtctatttatataaagcccaatgttaccctgaatgtgaactccctcatttcatacaataactctcaaattatgaatctttgtcaacacacacagacatatacgcatccacttgagatgtttccatggaaacatggatttattctcacaatgccatgcccttctgtaagcatagtctttgctgtgtttgcatccctccccaacctgatagattggaagaaaatggtgccctctgatgtcagcctcccttaaaggggccccaaggtagcatgtcttgggcctcaagtatttcaggccataagtggaatggagtaatccctacaaccctgtactcagaagcctattaccttactttgacttggctttatctggtcagtctcattttgtttggctctttctctcttagaataatagtttaagtttcctttaagtacagttttctgccactgtacgtagagttcataaagtaaagaaggttctacctactttcccgcgaactgatctttgccttctcttagtatactacaagtcagacttgcattatgactgtgaactaaagatcctaatcataaacattcagacagaaagaccatttcagtgacagaacaagtgcaagtctaatctataatgtatgtggagtagatagtgattgtaataatatggatgtttatgtatacattttttgtaaaaaccaaaatattgtcaacccaaaatttaatttgtacatttatacagtggttggaatagaggctcaacatttacataaaaggctttattttagtaaacgaatggccacaaactattatgtgataggttttggatgacatacttactgcatttggatttagactcaaccacttcacatcaggtgcaagaacttccagatcctactgattgtgcaaaagatatatccattttgatttggatttcaaatgtaagtgctgcttttctctctgcttcagaaggaaactcaatttcttttcattgctctttatacatcaggtgccttcatttcagcacagtatgtaaaaagcaggtggtataaggagtactttgaatgttaattatttttttcatcgatttcaccatgaggatttacctttcaatgtgtttttataatcaagatggaaacaattagggaacttgctgtttgaatgtttcactacatttattttatgacatctgctgcaatgattaagaaaaaagagaaaaagggaggcaagcatttgaacaatagcaaggggtttggattgattgtatgtgattgctttatttcattgtgaaacttcaaaggaaatgttgtcgagatgaatcagtcacgtttctaaccaataatatcatcccattgtttgaatttacattttttacatagaagcacatgagttcatttttcagagatgttgtcatagtttattagccttcattttaaattgaacctaattttataaactgcagagaaatggggaaaaagggaaaaatagatatttcttctgaaagaaaaatttcaaaggagaattttttttccatttgtcatatttggtttgttcctcaaactttaaacataatttacttcatctgttcttttgtttcatatacttacaaacatagttcataaagtaaaaatattcaggattaagaggttcatttttcgtaacgtattaagatatggtcatataatttcaatgtaagggagtacttttcaaaattaatatagtcaatattttacactttgttacattactcttatttttccattaacaaaatattataggaaaccttatgcaatgagaaactaaaacttgcgtaacatctagtaattagataggataaatactagacaagataaatatagttatataatataatgtgtcttatatatatatatatacatgtgtgtatatacataaatatgtatatttcatatctccaaagtctacctgtttaagagatactcaataagtagatctcaaagttatctctgacaatacaggaacatatccagaagatatcttactattttatcacctatagtaaggaataaaaattttagtccagtcaccaaataaaatgtggggttgaagagaacattaagggttactgtttttaattgcctggagtagacagaacaatggtcccccaaaggtgtcctcatcctaatcccaggaacctttccatgtgttacattacacaggaaaagagacgatgctgatgtaattaagttggggggcttgaaaagagaagaatgtcctggagtgtccaggtgagcccagtgtaatcacaagtatatctataagcaaatagggaagcaggagagtcagtgagagggaaggagatgcgttggtagaggcagaggagagaccacaagagagcgattgagatttgaacatgctatgctgctggctttgaagatggaggaaggaggcgatgaaacaaggaatacaggtggcctctagaaaccgtagtaggtaatcaaacagatttttccccagagcctcaagaaggaacatagctcagctgacaccttgacgctagcctcataagacccatttcagacatctggcctccagaactgtaagaaaatcagtttgcattgtgtgaagccactaagtaatttactgcagcaagtagaaactagtacattacctctaccgctactctagtatttcgcatccaaatttagaacactccttttgaaaatcctagactttcccactgtcttcttttgggtggtgatgaggcaaagatgattgacagatgggtaggcaaacagagtaccctccttctgagtctcctcagttgcactttcaatgatgtttattaatttaaaaactatccagcatgaatatgtacaaggcactgggctcggggctggggcacaaacaaaaacaaaatagaaaacccacccacccacccacacacacacacacacacacacacacacacacacacacaaacaatctctaccctcaaggggaagctaagccctcagtagtgaaaacagattcatctggatggaagttcttaaaatgtgttccttggaccagtagcttcagcatcatctaggaacttgctaaaagtgcaaattcctgagctccccttcgagtatatttcttatacaataattgctgtggtttggtttctctattagaatattaggactttatgaaagtttgaaccctgtgtgtgtgtgtgtgtgtgcatctcttgtgttatatgtaggaattcacatttatatatcctagagacaagacagtgaaaacaatagaaagcaaataagcagagtttggaggctcatggtccagacttcctggcaacaggctgcgtaacactgcttagtctgccagtaaccctagctccagcaggtgtagcccaaagtgagggcagaggctttccaagttgaatgtgcatgaaatcacctgaagcctttgttaaagcatggctttcagtgccctatccctcaagtttctggtttagtagatctggagatggcaggagtcaaaatgttgctttttcttttagagacagagtctcactctgtcgcccaggctggagtgcagtggcgtgatctcagctcactgcaaactccacctcccaggttcaagcgattctcctgcctcagcctcctgagtagctgggattacaggcaagcaccaccacgcccggctaatttttgtatttttagcagagacagggtttcaccatgttggccaggctggtctcaaacacctgacctcctggtctgcccgcctcggcctccaaaagtgctgggattacgggcttgagccaccgtgcccggccaaaattttgcatttttaatgagttcccaggtgatggtggtactgctggtccagggaccacagcttgagaaccactggcaaagccctcattatccaaaccagctggctcacaactgccactgtgggagaagatgcttctttagcgtcactgtggacccccagtacctgcagctgagacacagggcattacctgtggtaaggatgaggacctcttcccgactccaacccacagtatgtcggagatcagccacttataagcctctcttcccgcatatgccctctttgtggtcattgcacaacacatttctcccacagtggcaggtgatatggacaagggaacacagagaccgcgtgcctaggttagaagagtacagaaccaaggactgtgtttgtttattggaaagcagccctgtggtacgcaaaatgcatcctgagcagcatatattggagttgtgtatacaaaatcatgtatgctactaaagggtccttgttatgccagggccacgactactccaaatgtcatgctcggggtcaggttccagccccagctgaggtctgatgggagtgggtggatgggcagatggcaggtgaaaggtagttttatttagcagctctcttatcagcagctctctcacactagctctcttatactctctgcctttatctcggctgtttgctccggctctgcggcccctgtcagcagccaactcccacacacagccgcaggaccagcctgcaaggccagctctcccttacagtgttagcagcttaactctttctctctctgggcacgagtgcgagccatggctcccttctctccgtcttgcagtactctctctctttctcttggccccagcacaagagcgcctgtctggcatcagcggggcagttatactttttacagacagtagtgactcagagccaagtgtgaacttaaacagattatataaaaagtggagtatacacctgcaccctaaactcactaagtcatgctggcctggatgtccgccttggcctattcttgagcaaagcacatccatacaccttacagtcattctttccttattttgatgaacaggatatatggggggaaaatgaagataaaaattccccatcattttcatagttctacttgtctttagacatagaaacaagaaggagtcatgtgaaagaagatggcattctctctacaagggttgaaaaaagagcaaaaataggatcgggggcataactcttgctcaacttgcggaagttccccacacaaagtaaaaataaaccctgctttagcagcccttatctgatttaagtcagtttgtcttccaagatctaacatttcctccgttgaatttgaggggcttattttaataagaaaagaaaaaaggagaagctgaacagggcctttagagcaacacacataagctgtttgccatattgaatcaacacctggggcattgatctgaaagctaaacgcaggctgttcacctggattgccaagtataacagaagcaactggctcactgacatcagagagagcgtacttcaccagggctccatctgcaattgcctttgaggaccagagataatcagaaaaaaagtacagaggttgttctgaaacctaattccaacttaggagcatttatttctcctttccgtaaactacctgtgatttctaatcaaaaatgcttttctaaacccagctgacctaattctccttttctccctcacagcgtgtctttttgttgttgtcgatctttggcttcgcttattcaccaagcacagttgttgttgcctagctctctaagcttgtgtgtcctgcctttcccaacattccaaggagtaatggtctcattaacccagtaattaaagaaatcctgtacctttccactctggctagctgccctcttccttttcccctattgttctctcagtaacaccaccagcagatggtttgagattttcaccctttcaaaagctttatgtttttcccatctcatcaagcatatctcagccaagtgtaattagcttaaggcttttgaatccttaagggagatcagttaaagacttgagcaatttcaatgaagagcttgaaaagccaatcctggaaggctaagggtaaccacaggagagccactattatttagaagcaaagaccctctcctccgcccatccctccttctttaggcactttaaattctcagaatattcatgaggcctccagggctttgggactctatttggaccattattgagtaggtgggatatttaagctcttactcatcatcgggtcagttggttccttttaattgatttcaatcaaggggccatttttggggagccttaagttactctcaaatggccaacagtttgtttgctaagtctcttagccttttcattcctttctttatcctttggttgttggaaactagctttctttgtagttcaagcagttcatatgaagtctaaattaattaactgcaacacagatttgcaccctacctttgagtgatggtgaacccccttgattcctgaatagccacatgtattgtggtagttgatcccacagcccaagccctttttccccatacttgggaaaaagcaagttgttttgagaccaaattaaactctatttttattgaaatggagtggagtagtgcttaagtgtgtgaagcacagattgttggtgggatgttaagagaggggcccaggctctccctcgaattgggtgatgtgtattttccccatgctttcaagtgggaggctcggaggctcaggtgttgggtaataggatgattaagtgtgttctcatgtctagtttctcattaccaagacttgggtaaaaggagaattacttttgtaaatctactaccatctttttcaaataaaaggaaccaatgccaaaacatttgattagaacgacctctttttgtctcaagtacactaatcagcttctgtttgaacagtgatgcataggtatggagatgtgcctgtattaaatattatacatctactgtaccattagaggacactacaatcacaacttagaggaaaattccttgtaaaacatgggatgtgtgttctgagccgtggtatgacatggaattggcttgcaaagcagactccaaatacttatgaattaatttattgctgtctgaaaaatatgacataatgtttgaagtacaaattggcttacaaaaagatataagcagggtgaacatttttggtaggtaagacagaaatgtagctgcattttataaatgtttgttttgcataggagagtgataaattacagtagagtttcactattattgctttgaatacggtaggcctaaagaaactagactatcccagccaacgtggcagttctgaaccacagaaaccagttgcattggtgcagagtaggtaagacttagaagaaagaaactgctgacaacaccttcactttataacaacatacagtgaggcagaggactattagcaaacctgataccacagtgtccagaaaatgtgcagaggtcatcttctataaggtttcttatacaacagtttcaccacggccatggtgctatgggcaggaaagcttttgtttattccatttttcaaataactgatgcttaaaaaatttttaggcacagtcaaaataatatttaaaaattttttcaaaacagcggtatctacttttcttcaaactgaaattacaggaattaagggtatgaggagtaaaatatacctgaccagggtcacacattcagtaggtggagcaaggccctgacatttattatctaacttgtgacccagcatcctttccaccctacccttttcccctctgagctgctctgaggggctgtggctaacagagtatgacactcgagagggtatgtacctaattgtaacttacccaactttatataagttgggtatagatatataaaatcacccaactttatataagtttcacagttggaacctggaggtcaccttgttcaacctcctgctgtgatgcagaaagccttgatgatttccttcccagctgatgctgtggcctctgtcaagggacatgcacgatggggagctcactatctttcgcaggagttcttttatcctcaaagattgagtgtttataaatgaactggattttcctgacgtttctgctgactcatcccagctttgctctgcagagggaactgaaatgaacctggcctgtatggcaagagtctcctaagtctttgaaggcaaagccttcctatagcgccccctatactgtcttctggttagtcgtttatctcgcctattccaaacgtctctcacgttacatggtttccaaacctttcatcatttgactatgtacttctaagcaagtcagatttgccaacttctctctcaaaccgtggatatagattgcacacagtgatccataccttcatttgtctgattcaaagctaaagatttatttttaatagaaattgcttcagcccctggcaactcagtacatgaacttctccctgggtgaggtgaagaagtatcctggcagtgaggctaacagccagcccaattctgaagccagactacctcagtttgcagacaggttgttctctaatgagccatgaacaggtcatttaacttggtttccgcatctgtaaatggggatcataatagcacctacctcagcaggttgtttatagggatgatatgatttaacatgtgtaaagttctggcagtagtgccaggcatatagtaaactctcaatcaatattaattattgtggttatcattgttctgagtaaaaggctatactccaaaccaagggaaaacctctcatttgtttgtgatgaacggtgagaaacctaagaactacaggaacactggatgaaacgttacctcctgccatataattactttgctaatctcctcccttagtctagcacaatgtggaaccatgagagacattcaagttactttcatcctctaagtgcgcccaagctagaagtccagtagttttcctgttgctgccaacatctttgatcaaaagagacctcattgaagagatgcagctgatcaagaaaaattccctccaggctttggtgtctggcagatgtgctgtgtcatgagagtgcatctgtcagagctggctctgtccccatgaagaattgacagggccatgcaaacaaccccgaaatctggcaaaaatgaacctgctaacttagggaagaaaacacgaatggaggtggatcgatgtgcacccactgcctttattcctagtcaggtaccaaagagtaaatgttgcagcatgtaccataggacagtgacagtcacagttgacatttgtatagaagcctgacaaaacagggacacaggagcatggaaacagctacccctacccctcagcttaaggatttaaagtttcgagatttatcattaattttatccccttactcatgttccctgtcttggggttttctttttactagaacttcttccagttgtttctgctgagatcaaagcataagaggggccaggcacggtggctcatgcctgtaatcccagcacttcgggaggccgaggcgggcagatcacctgaggtcaggagttcgagaccaacatggccaacatgttgaaaccctgtctctactaaaaatacaaaaattagccaagcatggtggcgggcacctgtaatcccagctactcgagaggctgaggcaggagaatcacttgaacctgggaggtggaggttgcagtaagctgagatcttgccactgcactccagcctgcgcgataagagcaagactctgtctcaaaaaaaaaaaattataaaagcataatatggagcaggagacagaaacaccgcctcctgccttgctctgtaacattctttctgccgcccatcctattgaaaaactcaacatccccaaaggagccacattctccgagagaagcagtggactaaggaaaaacagaaatttagattctggcaaatcagtaactagaagaaattgctgggagagacagtggtatgtctttataatccttgtaggtcattcctgatgtgctcaaccttagatgataatggcagaagtccaatttttctcttactgtacttgattttaaatgccagggtgagggtcttgcttcatataagcttcattataattaaagtcttaatcatttaaattattacgaaaatcacacttcagaaaaaaagaagagagaggagagggagagcatgtgagtgagtgggtcagttgggctagtggcgcatgtcctggtgcatgtgggttacctgtacagcactacacagcctaattgcaggagtgaccttcaaaggcccttggctgcagggctcccacaggaccagcatcttgtgacattttgctctgtgtacaaaatcccacaggcgctcatctcttatctctgcatatgccagtgatcacagccacagaaaccagaggacagagtataaaaggatagtactttgtctcctaccattttatcttattgtccctctagaatttatattttgtaccagacatattgtaacaataaagtcagttctaagaataggaaaaaaaataacactatgataccacaaccttattacatcaaactgctttgggctttatcctctttaaagtgtgctcaggtgttcagccacgaggtttctgacagccctcataagacctccaaggtgtggtgtgctgattctggcttccagtctttgggatccttcagagcttagagtctgtttgggagacagcatcccctccatcccttctggggaaagatttagaagcccctggcaatcactttgtaccaagcacatttcaagccctgtgaatctcgattatttaggatttggattctggcaaatcagtaactggagtaccctctcaacacagcacataatcatatatggtctattccaaaccaagacctttctccccaaacgtggtgttctccttttagaaaccaagccagtgcttttcacatggtgaaaatacatttcaaatgtgtgacaggctgtgaggaaaggctttcctgggcagactaaatgtataacacttgggacagagtatcttttcccaaatgggaaacaagatgatttgggtcaacctgtgctgagactgtgttggtgatgcagggatgttgggtgtcatagatggctttgtgagctgggaatctgaagaagcatgttctaatcgagtttctggcagtcctctccctgttgaacaatgaaattgtgagaccaaatgttgaccacgcggcacttctttgttaaagctgtcagcactcactgacgggataaaatggcaccagctgcacatggtcagagtctgtgaggccaaaacaaagccactgttctagaatgagccaattaaccacaccgtttggctgaaagtggcttctgcctgacatctctgaggtagatgcaaagtcccagttgtccagagttgaaccagtggtaaaaatgttaggccccagtggttctgagcggtgcaaattgttctaaggtgcagagtgtcagtccaagtcctgccaggagcagatgctaagatgggatttatttgggggaatgcaaggagtttattaaaggaaatgcctgtgtgagaggaaagaaagagggtgctggagttgactgggagagccatcagccccagctcaagcgcaagcccgagtaaaggagacagggaaggcagcttgtgaggtgtgcagtgtagggaagttttagcaaagcatccagatgcccttgaggcaaattaggccaagaacagccctgtcttagtatccctgctgtgatcagtccttgactgggagctgcctgtcaggggctccggccttggagcaaatgcagtgatggattccagagggtgattcgtcttgcacttttcagctccatgatcaaggctccacatctcaaaactccaggcggcacagtttattatcagtgatgcccccagtgatgtgccttgcatgggctgcacagctccacacgatggtcctgcttagggtcacttgctccccaccatggtgactgctcaggcagacccaccagtcagcaccatcagctactttccaggtcccccattcagggaatgtgggaacatgaagagattctcggagccaggcctaatgatgctgagacgccagcttctctgagcctattggcagctggggaggggtcactctcctagcacacatgttccaaatcccaaatgagaagtgggcacaaagccccttctcagtttttgacttcaccccaccttgccccacttatctacaaacctccttcctctgggtctttggccttttccccacattagagaggacacaccgtgaggtagactttccatttgcttttcctttctgaatagagctgcttctacattggtggttctcagctttgattgtaaatggaaattacctgggagtgttcaaaattccacttaggccatactcccgaccaattaagtctgacatttttgggaagggaagcagtcatcagcattttaaaaatctccctgagtgactccaatgtgtagccaagatggataaatccttctctacagtcctcttctttctcaggatgacgttggcctttcccgcttctcaatgactacaatggtaatctgttgcttaggaaatgtgatgtgtagtgtagaagaatgaagccgaagcagaataatatttctaatatattatctgattacagtttttatcatacaaatgcttagttttaacatttaggataagttattttggtttactatggttatagagcagaatgtcaatgttaccattcctgaccatgggagagcacgtgtgacagaaggcaggaagtgtaacaagagaaggaaagctagagggaaagtgtggagaacttgtaccctctaggagcattaattaaagatttacagataaccaatagaagagctagaaagttggctgggcgcagtgactcacgcctgtaatcccagcactttgggaggctgaagcggatggatcacgaggtcaagagatcgagaccatcctggccaacatggtgaaaccccatctctactaaaaatacaaaacttagctgggcatggtggcgtgtgcctgtagtcccagctacttgggaggctgaggcaagagaatcacttgaacccaggaggcagaggttgcagtgagccaggatcacgtgactgcactccaacctggtgacagagcaagactctgtctaaaaaaaaaagagagctagaaagttacgttagttatcaaaatctaggaagagaagagggtggcataagtaatatatatcaccattggttattgcaagagtcaacagctacaacctaaggcagattgaacaaaaatagcaacccaattccatgtggtgtaaatgtaagatgatgaagaacctaaaatagaaattgtaaagacttgactcgtaggggtggacctgggatagggaagatgtctgtactttaccttgtacctgtatctaaaaaaaataacaaattaaaaaatagatttgagattctatacctcagtgcatatcaaggggtagtttgggagaacacctccagtcaaggccatgttttctacaacaactgctgcatatgagaatgctgcaccctgaacccttgcctgcagcactgttaaatgcccaggtgacagtgctctgactctccatggccacgttcttccattttagtaagtaaatggcctaccacagtgttgctatatttattgtcttttaaatgttgtatcatacccaggagagagacagagaaagtaacattcatggagaatacacagagtgacattgcaatttaccacctcgcagattcctctgaccatagctgtaagtaatggcatcctattactgccagaaggtttagcagatggttttggtctatgtgccaggtgcctttaggtgttctgagaatatctgttgagataggccctgtgtaaatggagcactgtattgaatagaggaactgtgatgtcccatcctggctatatctaccatcaactggttccacatttttaactgcgacatttaacttctgtaggatcggcaaaatgaagggatccactgactcaaattaacatccagccttaacactttgcacatcaagggtttcttttagaatagaaagtgtcagtgttggactctagtctttgctaaattttttcctatcacctctattcagctttaaaatataggtctgcctgttatgcaagtgagcaacatgccttgtcttcaaatagactaggtgaaaattccagttctatcactttttggctggatgaacttggacatgttacttaacttcttcaagcctcagcttctcacctacaaagttgggattgggtgtttactattgttatgaggatttgaagctgcagtgtatattctccggttctaaaagattctcgataaatagcaacttttgttacactaaggaagaagttagaagaataccatgctcccaagattggaagacccaagatcataaatccacagggaaaagtcctatgtggatttgcagattactaggtcagatttttcccatttctctcatttgtaaagcaaccagccttctgttccactacagagtctgtgtgctagggaagactctgatcaccatctgggttcaacagaagccaagaaaaataacaggacagcaaattaaatatccacgggccatgtccccttcctgtccctggctccccagcctaagcatctgctgtggtttcaatacacctgaccttccttccatgcatgtcctttggtgagggttcctgtcagggcaagtattcctttggccaagtaaagaccccgctctcacctcccaaggtaactgattttcatcctttgaagttccttgacttgtgcaccttctctctgggttggggttagagctctcttataatccattaaatcaagtcctatattctcatcttctatctataggaaaatgagagggaggcagaagagtcaagaaaggaaggctatatcctaatggcaagtttattttgctgttggacatcacttactcttcagtttcctcttttttttaatagaagcaatatttattcagtcctgcaaaagagactttattattttagccttgtgactgtatattgtttgcccttaaagactaagaaggaatcacctgtttatatgtatagaaacctggtcatttgtttttaatttaacaatattgttataaagtaacttactgttgatttaattattaaaactaagcagacaatttaaatgtaatttaaataccatgtgttaagtatacaccaaactgaaacactacagcactcttcccagaagtaacatcctgagtagtgtaatttttttttctattttttccatctctgtagaaaataaaacagcactgatctggggaattggaggtccccacccaattgtcgttattaaactatctcacctagtcctgattcagaggctgcagctctgtttatccactttaaacaaaaggagctatctgttgaataggctctcttacagaatttccctggatatgtcaaatgtttatttttccatgtaaattttataattggtttgtcttgttctaccaaaaaaagaaatcacaatggatattttattgggattaattaagttaaatttaggccatccttacaatgagtctttcttcccaaagtagcctttgtgattaatcttttatagaatttacatttttcatttatataaacttttaatatttttgttgcgtttactgttgactaaacttttttgttatttttcctattgtatagttagcttttggtaatttaataacattatcgaagctgagtgccagaactattgtggttattcactgctatttttaacttttctttggagaattgtatgttaatattctttgtatttctagcagttattcatctttgttcttattgatttataagagtatttttaaatatattatgacttttttatctttggtttggaggtgtgagggtgtgagggaacttatagattatcctgtcctgcccatttttcctactaattaagaaactgaagtgagatgacttttccattgtcacacagaaacttagtcctgattatccaatcaggactaaaaataggtcttttgggtccttattttgaggtttttctctcaagtacttgcctccttgtctacagttttatctttttcctcttaaattgacactatcaggttacttgatttgattagaagtaacaagttggttttctacctctacaaatgaatcaccaagaactgattcatttcttggaagttattgacaataactcccaaatcttgtcagtgttggactgtgggctttgctaaattttttcctatcacttctatttggctttaaaatataggtctgcctgttatgcaagtgagcaatatgccatgtcttcaaatagactagaagaaaattccagttctatcactttttggctattgccaaaaagttgatatctcctttgaactctagatttttctaagacatctctccagttggatgtctcattgacattttcaacttaaccttttcaaaaatgaggggtttttttgtttgtttttggtttactcttgttgcccaggctggagcacagtggcgcgatctcggctaactgcaacctctgcctcccgggttcaagcgatgctcctgcctcagcctcccgagtagctgggattacaggcacctactaccacgcctggataatttttgtatttttggtagagacggggtttcaccatgttggccatgctggtctcgaacgaaactgagcttttaatatccgcttcctcatctgcaattcttagtctccttcatctgagcaatggcaattccattgttcttaatggtcagattcaaaattgtgcagtctttgactattccctttatcccaaacatccaattcatcctgaaattctattggcctattttcaaaatattgccagatatgttcacttctcccatctcctccaccctcaacctaatcaaaactacctttcacatcaatgattgtcatcactttgtatttggttcccttgctttatctgtaacttcttgtattttattgtcttaccacagctggagcaagccttttacaaaataagaatataacaatcttgaaccactgccctctttcctccaagtttctttttgttttctgatatcaatttccttaattcactcatgcctttgtttgtcttcaaacagtataagcgtactcttgcctcaggacctttgtacttactactactcctttccctgaaatgccaacctccacacatactcaaatataagcacattggctgcaaggatattttctgctttgtggcttctgtatcctcaggacctagacagtatctgacactcagcaggtacacagtatatgattgcagaatgattgattgaaccatacttactagcaatcatttttggtggtgttgtgaaggatattttgaggcatcatgtggtctttgcagaactggttgaatttctagaactaagatgatactgctcacttactgatttatttgctttagaatgaaattcaaattcctggccttgtcagtttccctcctttctctccctccttctccactctccaatcacaatggtctcttttcacctccttgaataagccaagcctttgagccattttgctggaggtgccccctaaggagaaacatctgtttctgcatcttcacatagttgactcctcagagtacatatatcaacagcaaataacttacctatcacttctaccacatattgccagaggctcacatttcatgacacatagtgggtacttacaaaatatttggagaatgaataaatgtcattagcctagcttctaaagatcatgagatgcatgcccccatgacagcaccagccacatggtgctgaaatgatatatttgtgagtctgtctcccacagagtctgggagaacctctgagacagatataatgtttaattcatagtcactgccccaccgtctcctacacctagtggcatctagtggtattccatagatgtttgctgaactaacatgaagctacagaaaggcctttagccctcttcatcaaattcatttcacttgagagatggggaatatggagcacagaaggtaaaatattaaaaaatgaatattatgagatggctcaggaaggccttatgaggaagaggacaacgcagagcaaaggtgtagagaaattaagtgcctagaattagctcccatagggagaagaaatgcagcagtgagatcatcggtttaggtactcatttcagaacaatgccaaccttctggtgctagaaatttacaaggcctttttttttcaaggctaaaaaatgatgttactgatgtgctatatgtaatggttcctgtgagtaagtcatccttttgactaccaaagcatactctttatagtagctgtttcaatgttccccattctctctctctcttttttgcttttcttctccaaaccccttttccttgcagatggtcttatctcctactttgctgagaaaatcaaggtcattaaaggggaaatctcctaaccttccatcttccccaccaaaattatctttaaccggatatatgtcccctcctcatcctcttctgtcttggcatcatagccttccaatattgaccctaatattacatctggattcctttctttttttctttaatcatctgacatactgtatcctcaattatttccagttttccagcattatacaaatcttttttttccactgattccttctcttggaccttcaaacatacacaagtctttcttgtcttgcaaggaaataattgttgccccccttcaagccaccatattttcctttgtggctaggtgtcttatatgccttcatgacttaactctctctattctttcaccatatagtccttcactatcatggaatcctcatgtttcaggtctcagctctgttaacatgagacatcccagaggcttctcttcttttatttaaaaagtcttctttaagagtttttctactctccccaataaaacaataaatctatttccaggatcactgagcacattctgagggccagacactgtttgggcatcattcatcaaacatttgaatgagtcatagaaataggacactggactagatggataaacattgaggcaaacataaatatgtttttccaggggtacaaagagaaccaaaatttgaaaaactttaaaaagaacaaaccaacttagaataaaaggtataaaatggtaccatacatatgtacacatttttttatatactgtagagggtggtagatggacaactagccgggtttgcatctgaggagccacactggtggaaataagggccatgctgggacctgcagtgtgagtagggttagctaccttaggatgggggtgggttggatgttgcaaggaaaaggaggagtacagtcaagcattataggaaaaaatgtggcacagtgtggcgcttgccatcatgcacccacattcactggagactttccttgcttgcttcatattccatgggagttctgagttggagggaggtgtgtgagggactactccacacagttattcaggaacccaggattattccttcttgtgcatcttgtaactctgtattgtttagggcttcagtaaccacaatgtggttcctggcccagcagcaacagcatcacctggtaatttgttagaaatgcagattcttaggcccaccacaaactggctgaatgacaggctgtgagaggatccagaaacaaatgttctaccaaactgtccaggtggttctaatgctcagtcacatttaacaactcctgcccaaggcccggcagaggagggtagggcacatagagatcacacaggagagttttcaggtgtcagccccagcagtagcacatgttgcttctgtccacagttgttggttgctgctcagtcctgaagccctgactgactatccaagaagctgagaaatagcccagctctgtgcccaggaagaaagggctcacctcccaactgttcttcccactgccagtctgttccccttaaattcattcacctcagctaatcatgcaaatctgtgatgaccctggctgactgaaacttccacgggtcccatggccttctgaatgacatttcttagtcccacaaaggctggttcctgttgcctctctggcttcatggtttgccatcccaccctgaccctgaactctaaactccagccgtcttaaactattacaaaaacacctggctgatctttacccagccctgtgccttctgctctgggcttttgcaccttctgctcttcccatggtcctttgctcctggccattcccattcatccttcagggctcagccggatgtaactttgtctggaaatatctccctgaagccactctctacctcccctccacccaagacagggttagatggtctctactaattcagaataatccttaattactttggcttgtaatcacatcagtctgtggaaggaagactgtttcttatatatagttgcttctttgttgcctgtaaagagcttggcacatggtagatgctcagcgaatgtctgctacgtaacgaaagcaaagtggcctactagatgtttagtgggtgcttatcgatgaggacattgattgtctatctcatactttggctaaaatttattattaacgaattcactcttccttaattaggtactgcatcttcattgcagccaagaacttcaccactgactaaaagcatgcagccacgtacaagtgggatggggggaaggaaatccatccccatggacagaaagttaactcaaagcctcgctcggctctggtcacagtcagcccatctttttcacagacaaaaatctgcatgtcttcatcttacattaatttacatatgtaatttacctaataggaaaataaggaagcacagtgtttgaagtgtaatcaaattacattgtttagaaaacagagaaaaataaagcttcctggtgctggcgggtcaacaaagatctctcagtagcttactcatccaccaactgaatcagtcccctgttcctgtcaatgcttctgccatgactcattctggtgggcaaatttttaatagaaaatgataaactcagggatattcaccttaaaaatatgacaacacttcccagggacatgaaaataagtagtattattctccaaaagttaaaataatacctgtactcagaacgtgagtagcaaccactgtcttccccttgcccacagcctccatgactcatgaccgcattctctcctggacattgcctcatcagtgactgccatctctccctctctaactgatttttgtgttggatcctccaataaggagacacctagttggagttaggagagcacagggctcactgaggaataagacatgcggaagttgaatgaagcagcagagttgtgcagggagagacagaggtggcatcgcctgtccagggtgcgcagctagtaactggaaaagccaggatcaaaaccaggcaaagcgagctccagaaaccagtggcctgaacactgccttgtactgtctgtgtcttcccctgcccagatggatagtgcattttattcatactgaaataatagctgttcataattggttattatgagcctaacactccactaagtgctttattaaatgcattacctatctatgaggtaggcgtgggttttctgacttttacctattaggaacctgaatcgcaatgaggttaaataacatgcccagaatcactcggccaataagtcggagaatcagaattcacatctcaaatttatgttctccactctgactccagggtcttttataccgctatttcttttgagttatttctattcatctttgtagttacacaatccaacaaaatataagcattgaataagagtttcctgaattaataaatgaatgaatgaatgaataaagtgcttttccagaaattctgtccagaattatgggtattgtggtcatttagcaaaaagtaggtcattttagtaagcaaatactgctcccaaagtttcagtttctttttttttttttttttttttgagacagcgtctcactctgttgcccaggctggagtgcagtggcgcgatcttggctcactgcaagctctgcctcccgggttcatgccattctcctgcctcagcctcctgcgtagcagggactacaggcgcccactaccatacccggctaagtttttgtagtttttagtagagacggggtttcaccatgttagccaggatggtctcgatctcctgacattgtgatccgcccacctcggcctcccaaagtgctgggattacaggagtgagccaccgcgcccagcctcagtttcttttttaattttagctatagcttttatgtaattaataaaatttctagttgtgaatacattaaacatgcatagtagaagaggtccaagaaccttaacattgttgttttggtgaaaagcaatcagtaagccaatgactctcaagcttttacatgtacaagaatcactagggcagcttgttaaattgcagattacgaggctctgccaatcacaggttcttattctgtacagctggtaagatgtctggaagtctgcattttataattatcctgagtatatccaatgcagatggttcctggaccacatcttgaaaaattcagatggaccagtggggctggcagttgtctaatcagcctccatgtcagacatgagaaaccttgaaacacacgtagcttttcaaaaggataaaacagtgtgatgtccgttgtttcctataacgatttcagagctatattataagacctgagacctgtagcacaaatgcatgtatgtgccaaccgaatcatacattgtgcatgaatgcatgtatgtgccaactttgcttaactggatcatgctggacagagcacttcataactatttaaaacttggtattgatctttagaagaagagctaatgactcattttgtataatcaatgtgtttatggcatctcagaagagttttatttttctactaatgatatcttactgaaattaaggtaccttccactgtaagaacaactcttctgtatatgtcactgagaaggaaaataaaaagctcaaagtggagagtttaatataagacaacaaagagcactaccctcagatgagactgaagaagatataagagatggtgccatccgggcatggtggctcacgcctgtaatctcagcactttgggaggctgaggcaggcagattacgaggtcaggagatcgagactgtcctggctaacacggtgaaaccccgtctctactaaaaatacaaaaaattagccgggcatggtggcgggctcctgtagtcccagctacttgggaggctgaggcaggagaatggctgaacctgggaggtgaagcttgcagtgagctgagatcctgtcactgcactccagcctaggggacagagcgagactccatctcaaaaaaaaaaaaaaaaaaaaagagatggtgccttggtttatggccctctaaaagcagatctataggccaaatcttgagggcaggtgggttacctgggaggcaatccgaggaagcacatgtgaggaggtggggaaatgagaccgagaatggaaggcacccattgaagtatgatcatgagcagactgtcattgttagcagttgggactcaatcccactgaggcctctgtgaagcattctgtagaacacacctcagaattgtacagtcatgggtagggaagctgggctgttacccagtgactccctttccttattggttgaagtttgtctgggggtggggcgagtagatctccagcacttttagtgaagagcagtcagtaagcaaatgattcccaaattctatgcgctcaggacccctgggctgtcctctacaagggctgaacaagctacattggtgcttttggtggagaagtagaaaaatgtaggcacttgaggagggataccatcagagtgcagagatactgtcccctgcagctgcagtggagctcagaggtgggctggggtgatggcccaggcatcaacaatagctgctccaaatagctaggagacttaggtgtcttaattgcggcattgattaatggaggtttaaaaaatgtccccttaataatttggatcacagtctaatgctaatcatgcaagtttgtgtcctaaattcatacaagtgtggttcatagaagcctcagttagggactttaagtggtttcaggttgataatgctgcctagtgtgactaacaaggaagtgcaaatcctctctgtctgaatgtggcttcaatccagattaatagcaattgtaaggctattgatcattctattcatttcaacttcttcaatgtgaagatgtagaaaaaatgtcttcaaaacaatgaaatacagtagtaacaaatagctataaaaaatacaacttccttcctacataataaaaatgtaaagagcactactttttcacccaacccatgcagccatgttcacacacacacacacagacacacacacacacagacacacacacacacatgccaactaccacatagcctctttgtaatggaggacattgactggtaaaggagagcctgccttctttctttctctcaggtctacaaccacgcaaatgatcaatattctattgaagtcagccaaatagcaaccagattaaatacgacagaaccaggaagctgaaaattgagggtagctattcgtataactcttttatttgctcaaaggaagccacagggcaaagggggagggggtgttcctgcttctagctgcattattttcaactttcaaatttttttttacgagcaaaaatgtctatgtaattctataaaaagaaagaaattaactctgctgggtttttttcctctttaaaaagcctgctcttcaggtttttatttgcagactggtctaggctttttgtttgtttgtttgtttgtttttagaaaagcattgtgccctgagatcaataaatcaaaactggattgccttcttctcaaaggtgaattgttatcttgccgaagaagttatgtgacagactctctagtttggtaaaaatacatgaacaagaaaaggattaaggtgtctttgcctgaaaggaaaattctggatgctatttttttctatgatagggaaagtttcttgaactgtctcctggaacaagaggttaaatgtcagtagctaaagcagctgtgggcccattatttggtgctcgcagagtccattctgtcattggaggtgctgttttcacacagagaatgaagtcagcttgacaactgcaggaacagctgtggcagcctgagatatgaggcaaggaggcaaagcccaaacagagggcaaagaacatctgtttgttgtcaacattctgaaaaaagcaaaagattcttgactatgggagagaccagggtacctggagataacagcagtcaagacaaaagcaattttcagcaggcagaagtcaatcaagcttgaaggaaaaggccagttaagatgcttagcacccaggggttctggaagagtgctgagccacccagagatgtcaggcctgagtggagctggtgctttgatatgaattcaggaagccgcctggggatggcgggttgggggacatcatcacagacccaactgctgtggattgacctctgccattactgctgggaccccaggccctctggtgctcaagaaaaccataaagccttgtgctgcctcatttttagaatctgttccctggcattctaaaccatgccataatgcatttctaaccacagggataagagatccaaagcaacattaatctggttttccagagcagggccacagagtgatcccatcttagagaattggccgggcatggtggctcacacctgtaatcccagcactttgggacaccaagacaggtggatcatctgaggtcaggagttggagaccagcctggccaacatggtgaaaccccatctctactaaaaaaaaaaaaaagaaaaattagctgggcgtggtggtgggtgcctgtattcccagctactggggaggctgaggcaggagaatcgcttgaacccaggaggtgaaggttgcagtgagtcaagattgcgccactgcactccagcctgggcgacaagagcaaaactccatctcaaaaaaacaaaacaacaaacaaacaaacaaacaaacaaaaacaaaggagaatcaaaccaccaagctttgatcctgaaacatctgaaggggaatgaggtccatgctacagggctctgcagatcctgcaggaggggagagcctcagtacaccaccattttactgtattcactgccacagatggtgcagatcatagtgatgtccctggcatgtgacaggaacttactgtcttcattgtgaatgagtttacttgactatgcctcccccaagaatctcaggaatatggaagatgtttgagtccattactttcaagtggattacagttgaccaggcaggcctgtgaaagaaagtttagggccacctttcaaattccagccccatttcacctgcctctgcaaggctctctcaccactgtcactagtgatggggtggaaatatcccagaagtagagttaggagaacatttggtcccaacctcattgctgggtggcctggagaagtcatgccacttctctggggtcctctgttcacatctctaaggggtttaattggactgggagacagtcaaggagttttttttattttttgaggaaagtggccctttttcagacaacaaaagacaacacttgttcataagcctaaaaagtggaataaagcccctacgaggagggtttcggcaaaggtaacatcaacatctcacaggtagctttgacttctccttagccaaagtcatctggctgagtttagtagcacttttggttgcatgtttagttaatgtgacctagacactctttcaggtgtgtgtatgtgtttgctctgggagtaattaactctcagaaggcataaaaatgtttaaacccaacaaagatcaaagattaaggcccaagtatgtgtgatattgctttgtgaaaataagctgcctagaaaatgggctttcacttaatgcagatgtgtttggaaacttctcctagtaggaaaaaaattctatcatttttctctgaagctgaaagaattggtgttgagagactgagaccggaaatggaattagcttagcagaaccgcatgcatttacttccagttcagagccctcagacagccttcctctaatgcttctgtaaaccagcaagattatttcttggatgcagcgtacatttctagtcctttggtcatggacaaaggtgatgcactagattttattaaatattcagaacaaattatgctatttaggaaaatgtgacctacaaacaggacaagatatagcgcaaataattaaagacatctataattaagaatgtataggattaagttattctttgactgaagagctagatacataatcatgcaggatttcaaccctcgccatcagagatgcttcttctgtgggccttaagtgtatgatgaagtttcaaagaattcagccttggttattttcagcactaagttccttccttgtgagatttcacataaagaaccattgaaaagacagaagttgcccccactgtggctccttacatagttaaaaccctattagagtaaaagaatcaagaaactcctctggaaaaagtacatatctctgtgttcactaggaccctgctgtgtacagatttagctggtttctgcagagaaacaaaagccacaaaaggtgcatgatggggtggaggggagtgttagagacacccaatttgcattattcctgctggaaagaccctgatctgagatcagctctggcagcccccagctgagaagggcctccttatagtcttcatttcattccagccaagccctggaggggtggagaatgcataatgaggctgaatgagaattagatgcttaattgaggcctggaaaagggaaagaaaaagccagacatgtggaatgtgatcagaatgcagctcagttaagccaaatgtgatgacacctgggaaggcttcagtggttgggaccactatacagagaagctggaactcctttgaaactgactcatccatctagttccaactcaaatgttattttcttgtcctcaaagatttttcttcatcctcacaaaaggtggctcactctctcctttgtgcatccaccatgcttggttcatatgacagtgcttgccatttggcctcgtgggtgggggatgactttctctctgcgttggctggcttgtgaactccatgagggcagaggtgtgcctcattcattttgtatcccagaacataataggcattgaagtacctggtggacattttttttttttttgctcttcttcctaaatactgagttctctgtagagtagttattctgacgatgactgatgaagcatttccaaaccattctcaaagaggcatatggaggcatattatctggccaaacataaaagtatttctatatatcaggatctcgtgctcaccctcagctatcatcactgcctttcatcacttggtaaagacagtttctgattttgattagggtagagtattcccaactaatacatgaaaatttctgttgccatggaaagggtcttttgtaaaaacaggcacaggcacattttccacaagtatgttcctgtcagtgtaatcattcactatttgactttggagagggggccaaatgtgtgtgtctacagtgtttgtccaagtgacgaagagaggttcagtggtcaagtagcagctttaggatggaggctatttggaaaaaacagactaggtgagtaacagatggcatacaatcaattgtatctttgtcctaaagaagcatggactaagtgtaaatcaagtgtatccatctgctcggctgccataacaaaataccttaggctggggcgcttaaacaacagaaatgtatttctcccagttctggaggctggaagtccaagatcgaggtgctgctaatttggtttctggtgaaaatttgcttcctgtttcatagacagccgtcttctcaccgtgtcctcgcatggcagagcagagagagatttctctcttcttctttgcataaggccacagtcctatcagattaaggtcccaccctcatgacctcatttaaccttggttgtctccaaaaggccctatttataaatacagtaacttgcaggttggggctacaacctttgaattttgggaggacacaaatactaatccatcatatcaagtctgatcagaaccatcatttgaaaaatattcttgaaaccagctgctggcaaaggccaggtgcatgtgacacccacaacgaatacctagaagaatcaagagcctctgaacacctgatcttgggtgaaagaaggtggtgtgtagtcacattttaaaaccttactctcctccaaacttaacaatatgaaggaagagaagtaaaacaggcaagcaagtatcatcaacaaaaacagtaattaaacgaaagaaagggtgggtagccagcaaaaggaaggcacctttctggaaatgtgcggaaggaacgagcctggtgttgccctaccccatccctaactctacaggctcagaaatcatcctgaataagatcacaccagctaccatttacctccctaactaggagagaaaaggccaaggaaatttccacaagagcatgaagtcagccatgaacaccttttactcagtctttccccagagaaacaagaataacctttgtaatcctccatgtcaatacctctgaaggaaaacgggaaagaaaaagcagaccaataacaaatgactagaactaattatctctagcaaaatcccgggaatttcacaaaatagaaaatttaagaggacatacataaggcaaggtctctggcgtgaacaagaaccagggaaggaggtgctagcaggccccaggtgatgcttccttgaagaaggagccaccttcgctctctgacaaggctgcagagggtttatcacctgctagggtggaaggctaagaaagaaaacagcaaaagggaacagaggaactttcagactgactctttctcctggaaagttctgagtctcatgttgaattgaaggaattatccaagccccaaagatagtgcccactatgggaagtccaagccccaaagatatcccccactatggaagtccaagatggcaactgtgcagacaaatttggggggaacctgggctgggcgtgggatatgctatatacttgctgagaaatccaacacaatgaatgtggctgctttacccctcccaaggaaaacctccaaatgaaaggcttctaggcagctgctggaggaccaaggagccacagagcagtatagaaagggagcagcttgctgacatgcatgtggcatacacatcaccctgcaagcacactgaaaccttgactgagaaagagagggaaggaaggaagagagcaagtgagcatgcaacccagtaaagggcaggtgaagaacgtactgtggaagaaaacataacccaagagaaagatccaaattccctgcaatgaccacagatgaactttgaaaaaatgttaacaagcttgaagatgcagtgataaaaataacataactgatctgaaatgtaagaactaaggagataaatgttccactcttagagaaataaatcagttaagaacagcaaagaccaaattactgacaaagaaaaaaggttgagattttcacagtgaaaatataatacatatggaagagaaaacacaaaaattgctctatgtgagaatgataggtgtcgctgaaatttagaagtcaatgtatagaacagaaaatgtcttaaaacaaagggaagctgaattgatgatctaatggtcaaaccatgttttaaaaaatcaatacagaaatctcgtcctgaaacacatctttgataagtttaacgatttttaataaagaattttatggttatactggcacatgacatgtcacttaaaaatacctaaaacttttagaagaatacatagttaaatttatttaatgtatcttaaagaaaataaaaagatgacaatccaggagaaaatattcacaatgtattagacagggaagggttaattttcttagtttagaatatacaaaaatcatggaaaaaaaacaatcaaataggaaattggtaaaatataaaaacagatgacaaaagacagggaggaggaagaaaagaagggaggtagaaagggtaatttcactcgtaatgtaaatcaaaacaatgaggacatactgttttcttccctgaaaagtttgagtatactcactgctggagattgcggagaaatcattatcgttatcattatcatgctctaagtgatctgattgatctgacctttttggaaggaaattttgtaacatctatgaagattaacagttcacatacactagatctagaaattcactcggaattcatccttgggaaatatttacaaaatctttccaaaatataagtgcaagaacattcactgaagctgtttgtaaaagcaacagtgtagaaacacatcagaagtccactgatgtgggcctggataaagaaattatgatatatctatatttatgcaatgagatattaacacagattacaatggcatgctcatcgatatatagtaaatgcatatattgaataggcactaaaatcaatgcacatattaaaatgcaatactaatcaatgcacatttgctagtacctgctaataaagtatgtacgtattataaatacatatatttatgtagaaaataaaaaggccagactgcagagaatagaaagtatcatctatattttaagtaaatgaaaactgagatgagagagggtatgaagtagggcaagagtgggaaaagagcaaagagagagaatgaaagagatgggaattgtgtgcattatttttttctgggaaggtaataggaacattttaacatggaaagagttgttcagggtcatttttcattagcatttttctgagcagtttgaaagtgttaattatgtgtaagtgtcctttctgttgttttttaatgtcactacagttatttaagggttaggtttattgaactttatctttatttctatttagaaataaacgcatgctattttaaaaagttagcatatagtatgttttcacctgtaagtgggagctaagcaatgagcacacatggaataaatatgggaacaatatacaatgtggacccttggagggtggagggagtggagtgggtgaagaaactaccaatcgggtgctatgcttaccaccagggtgacaggatccgtactccaaacttcagcgtcatgcaatattcccaagtaacaaatctgcacatgtacccctgtatctaaaatgaaacttgacattaaaaaattatatattaatatctcattaaattgtagtttgttttggttaattaaatcttcataaaacatgaaagtgtccataataataagtcttaaattcaaggaagaaaggaagaaagaggggagggaaggagaaagaagggaggcagggaaggagagaaggagaaactaggatgcaggaaggaaggtagaggaaggagggaaggagggacaaaaagaaggaagaaaagagggagggaagaaagaaaaggaaagagggatggatgagaagagggaaggagggaaaaaattaggatacaggaagaaaggtggaggaagaaggagagaagaagggaagaaagggaggagggaagagaggaaggaagagaggaaggaagggcaggaagggagggagggagggaaggggaggaaaaaagagagaaggaaggaagaaacaaaaggaaaatgaggaaaaggtaagaggaaggacaggagaggaggggaagactctggacaccctatctactaagaggtaaaaactgaaaatgcctctgaagagcagcacaatgggttaaaagcctttgacttattttgcgtgactgtgactaaagaatttaaacattacttttgactaaaaacaattattcttggcacttgttaattaaaacagcccatttccaactaaaaacttaaagactgagagtaaaatagctacatgttaataaagtttttatatggaatctgacttttaaataaagactggaccaatttacctatagtaaattgaaaagaataaatcttgttccaaagtcagaaagagagactgtgtgacattttatttttgatacttatttgttcttcatgtagatgtagaatgcaagaaagctaattatggacaaggagaaggaataaaagaaaaatacaatgccgaaaagcaacagtgctttctcctctgagatttaatctagctacatcagagctctaattcatttaactttttaaattaagcttcatacatagtaggtatgcagcacaatatgctggctgtataatagaataatgaatgaatgataccccagaggagggatatgtggtaaattattgaatgatatgaagaggtgattcagctaggtttgtgttcttaagggtcagtgataaagagatacccagaagtagccaataaatattaatcaggcatttatgatagtcagtcattatgtctttcaatcctccagttttatgagagagttatcattaactccctctacaagtgacaaaaccaagactctggaagtgagcagaacttgcccccaaatcacataaatagaaatgccaggacttggatttgaaatcagctctgcctaagtctagtgagttaaacttcatcccctttcactaatagtgacacctctgagaaagatagccagaagtaagcagacttgaggttcagaacctatcacagtagggggtggggtgggggagaaagagaaagggagagacacagagagagaaaaaatcaaaggcatactcaatgagagaaggaatttctagaagttggagttgtggtttgttgaatggcatttgttgtagggaaagtggggtaaattgctacctgttttattttgactcctttcacactggatgaattttaagagcaagtgtttaccccttgcacccctatggattttcacaaaatacctgaatatgaaacctggacattactacagctatgtgaatgaataaatccatgccattatcaaggactggaatgcttttttagaagttaaatttatttagtttatggctgttggaaccacatgatgattattttagataatgctgttgacttcattataaggagcagtttgtgggaaagcatcattacggtatagtgtaccgtggactcagcttctcttcaagctggtgttgatattgacgctgtgttattcctcattaaattggtctttgatctcctttcacttagttgcacatgcattctagacctagacagtgaactgggaagtctaggggaaaatgaaatctaattgagctcatcttttccaacaatcattagcttaaaaagaacataaattcgtgtctgtgcatatggaataatagccttcttccatccgagcttgggagttaaatgtacgtgcagatgccctaaactccaagaccagttttcttccattttagaaccataccacagtgagcacagtttattttttgtttgtttgtttttggtattatattcagttttaacactttattattattattttatttttccataagttattggggtacaggtgatatttggttacatgagtaagttctttagtggtgatttgtgagatcctggtgcacccatcacctgagcagtatatactgcaccatatatgttgtcctttatctcttgccctctcatactcttccccctaagtccccaaagtccattgcatcattcttatgcctttgcgtcctcatagcttagctcccacatatcagtgagaacatacgatctttggttctccattcctgagttacttcacttagaatcatagtctccaatctcatccatgtcattgtaaatgctgttaatttattccttttaatggctgagtagtattctatcatataactaatatataaaatataatatagaatataaaatattatatataaaatataatatgtaatataaaatattatatattatatataaaatataatataaaatattatatattatatattatatataaaatataatataaaatataaaatattatatattatatataaaatataatataaaatattatatattatatatataccagagtttctttatccactcattgactgatgagcctttgggttggttccacgattttgcagttgtgaattgtgctgctataaacatgcatgtgcaagtatctttttcaaatgtagaactcccagttaatccagcaatcccactactgagtatctacccagaggaaaagaagtgagcagagtttagcctgttaagggacttctcctttgtatacattaattcagtgtttctcaaagttatgtacactcaccatttgtagtttgatagatgattttaggtgatgtaaagattaacacattatggcatgttaaaaaattagccacaaatgaagctcaagatttcatagctataatttctatgggacaaaattaagaaaaatttagaactgaatcgattagaagtgtattattatgtgtgttagttagctatcaccacagtaatgtaatgcttcatctcaaaccatcttcaacctcaggggatttagaacagttgtctgttcttttgctcatggatattaggatcaactgcaactagtctgggccaggaagtgtatccatccacatgagctgagtcctggtctcatcctcctcggatgagctacccctaaagcatgttgtccttgcggtaaaaggtaggagaaggaaagccccaactgtcaaatgcatttcaagtctctccttgacacacttctgctaacatcccattggccaaagcaaattttgtaattaagcccagcatcaagagagagtgaagtagattcccatgagggtggcaggtaggaaggaaacatttctgaacgcattatctaatccaattacattaatagtgaagttggaacataggtatggcaaaagttgtcaaggtggttcaagaaggtttgctttcggttgataccactttaattcaatacaattgaatccagacaggccctgagctctgtacctatcatgtcacctatgcaactacagattctgccaaataattacttgtaattctatttgttgtgtgaagtttactgtcaatacacatctcaaaagaaaagcttggaggactcctcccccggccagcatctctcacgtttatatatttaaaagtctaattaactacattctgtgtgcatctcagtatcttttcttctatgatgacatctgcctcatttattactttttatgtaactccactaacctagaaaaaattgctataatcaagggtttgagcagtacagttgcagttgttgatagaaaatgaaaatagtactgaatgtcccagactttttctatttctgcatcttttatcccctgctaggagctctggaatgtacctcttgtttgtgtttcaaccagcagcaatccaaatggaaggagggacaggcaaactgtaataaataggccacagaggccatttttgtttttatcagattatgttgtctatgtgaaatggattcatttctgtagggcatccagttgcactgcccagcgatgtagaagctattaggatagtaccagttccacatgcatgacacagtaagaaatatctgtcattcctctcccactttccaaacaaacaactcacacacacatgcacgcacgcacatgcaaattcacataaacataccattgcacacatatgcatcatattcacagtgcatgtccacacatacaggaaaacctcatgtgcactcatgatattaaattaatgaacaatctctaccaaacatgatattggagtcttggaaagcagatctaacagactatacttccctctgctccaggaatatagtggtatacagagctacaactttgatttctgtttttttctctctgtttcatggatttcaaatctgccattgaatctcatactaatctatgccaatactgtggcacaacctgagatttctcacacattccattgtgaagtgaggttagaaggacaagcatagggctagaaatttaaatgtttactgttttctgatttgctatttgcattttgctttcttcaactttttcctctctctcacctaacttttgaaagtgttttgtaccctcccttatttcactaagcattgtttaatagactagaattatgcctattagatagaaagttctctgtgataccagaggggtttccccatagtaatgtaaccagggttattaccattgagagtaacaacttagaaagatatttcctgaaagaatcagctacaggtacctctagatcccatcagaaacaaggaccctaagaaaatagtcaagaaagtaatgcttagatagagcttatcaattaatttttccacagtaatcatttcatataaataataataatattatattttaaataggtctgatgatgtcccagagagttaagatgagtcagaatattttataatcattttactagtgaaaaagccaaggcttttaagtgctatgagatttggtcaaagttattgaaaaaattaaatgaccagccacaatatcctcttttgtgacacgtctgtttgtgtcttgtccactttctgttgggttccctgtcttttcaaggttattttgtatgtttatttcttatatattctgtacaggagtcttttggcttattttcctctcccttagcatgttttgataaacttattttaatggttggtgctttgtcctgtgtaagaaattttgcataatgatgtgaaggtctttgtccacattacctttcacatttatttctttttgagggtaggggaaactatttcttcagcataggtctgtggacaccaaattctctcagtcatattctctgaaaaatattttatttcaaattcaaatttgaaaatctttttttttttaacacttcaaagatgtcattgcatcatctctggcttccattatttttgttatgaatttatctataagttttattgttattttgaagttaatggatctttattcactagataactttttttttctttaatgttggttttcagcagtttcacaatgattagactgagtgatagtttttttcattaattttgcttcggaatcataacagtcttgaaacagtggtttgagatgatatctgatatctttcattaattttggcaaattatcagacattatctcttaaaatattccttttgctctattttacataggataaatcctatctcatatggttccttcactcttatctggggttttcatctgcaatttaggcttcgtatctttttccgacctagcttttggcttactaatcacctcttcaactgggtctacctgctgtcaaaatcacctatttaattcttaacttgtttttgtggggtttttttttttcggttctagaattttcatctgacttttgaaaaagtatccagctctctgataaactactttgccgtaaaaattattcaacttggcatccaatttccaaaatacattaattgttatttaagctgcctctgcaatacctggatctctgatgtctatccatatgtcatctcttttattctcttggttttcagtgacttgttcttgttcctctgaaatgccaggtaattttcgcattgaattctggacactgtttgaaaaactgtagagataacttgaggcttttaatcttcctccagagaagatttacttttgcttctgacagcagagcactataattcaatcaggaattgtattaattaaaagttagacttcaggtttttttaaagagatggtctatttcaagttcatgcttgtccccaggatataacccttcagggtaccccaccaaaaacctgaggtagttagcagggtacctctccttggtagaacccaaccttcaagttttgctccctgcccctagcctcacaaaacacctgcaggctctattcaacttcttgacacatgtgcaatgtcagcttcaccattttgcatttcctcaggtttgtcctgcattcatagcactctggggccttacaatgctattttaaataatatgttcagtgtttctagctgttcttggtagagggttagtctgaatcattacagtccaccttaggcagaatccctttctcattataattttaatttgcattccttttgttgttagcaaagtaaattaccttttcatgtgttttgcaggccatttttatatcttcttttattaactgtctgttaaatctcttgtccattttcctattaagttggtggtcttcttcatctccatttttaaaaggccttatatattaaagattgtagtaacactttgtctacgataaaaggtgcaaatattttccctcaatttgtagctttttaaacatttcttttggtattttttccattaaaaagtttattatgtttataaagtcaaatattttgttcttgctccctattacttctgtgttctaaggcataattagcaaagttttcctgctcgcaggcttaggggagttcacaaatggtttcttctgtaattgtgtgttcaaggagtatgttgatgaacaattgaaaaatgatatatttctagaataggcagtgtgagaaaggtattatatagtgttaacaagtccagttggaagttccaagttttgtttttccttttccacctcattctcaggagctagtgaaaagcactgtggacacagtgactttcatcttgtccttgaagagttgaggagaccatgagtcctttttttcccttgtgttatctttttcctgagttctttcatctactttcatactatgaatgttaccctatcttggtgtcccccaaatacccacatgttccattcataattctcttctcataattctctccccagtgctagatgcaaaacttgtttgatatctcacataaatgcccctacacttcaggctttaaatctaaaatgactttgttcttcttttcccactctgcttgttttatatgtcatcaattaatgacctctctgccattcatctacctaagctcagagcccagtcacctttgaatcatatttcttaattgtcaacctcaatacaccattaccaagagtacaaattctacctctgaagatctcttcctttgtagacattataaactggatctttcctgtccttgcttttttctcatcaataggcacatgaagtttaacatactctggacacagtaagtaatcaggtaatgaaaataaatttaatcctctctttaaaaatgtacaggaatcataaaacctttaaaattatgggttttctagcactttatgtatgtatttgtatttacaaatgtccttgctcttcaagttataaaaacttaagagagatttaactaagaagcaagaaatgattgtccttttgaatacctggaaatgtttttacaatatgaaacacaattcctttactacattgaagcatcttatcgaagcaccttgtgaagctgtgcaaatagaggccagtcacaaaggaaatctactgacgactaaattctcagcaatccgaaatggcagcatcagaggtctcctaaggaaacaactaaaccatttgtttctgtttaaaaaacaaacaacaacaacaacaaaaactctcactaccaggagaatgaatctttcagctttcagtcatgcctaaggcaaaattcattttctctttttcttcttctaaggttaaactacataaactctctctcacacccacccatgcatacagacacacttccctaaatttaaactgtaggttgttctgaggaaatcaacttttcctgctgtcatgctaccagatttctaatttgagaaactatatatgtatatatgtgatcatctcacaaattaaagagaacttagaaggccacacaaaagtattcaagcaactcaaccctctgtttcctcttttaaccttttctgcaaaagaagttgaatcccaggagtatttttgaatttaaaagggcaatggagggtgacagaaatgattggccctcaggctgttataattctctattcatcagggactgtggtctttttctcttccagctccaggcgaggacacacctaggatgcctgggaaaagtgaaggctccagtgacctagaaaatactccaggtcctgatggtaaggttctgagctattggagcccatggaaactacaaatctggcatattttctatgtgtaatctaggattaagggaactatctgttctataaagcaacatatttggttagaacacagtaaatttcaaaaacaattttgtgctacaaactaataaaaatggcaacctcttatttaaaaaaaaaacctgtttctagctgttttaaaacagcatatgtcctggtttaatcatatcttataatactgaggactcaatagatactttcaagactaaactgaactgaagtctatctagtgaactttatggaagcattacttacttctgcaaaaggtacttagcctacttagcctcctgttaccctgctccactcagcattcgggagagccctacctttggtgtgggctaagattgttcttgtaccttcatcacttcactccactgtatcacatccattgccttggttaaaaacatagtgagtctttaaaagcaccttaaaaataaattttcaaacaacctttaaaaacttacatctaattttgtaggcatctaaagagtctgagcctcaggaatattaatatcccttttcccctgcacaaagatgctaagggccctttgaaataccattacttacattagagaaacaactatttaagcctacctaatgtaataagtatttgattccactggcccatagagtttaggagaaccagaattggttaggtggtcagtcatttaagtatcttgccatttgggttattttagccaaaggaaaaaaacaaattactttgagttgataatgaccttggaaaaaatttagccaatggtggatgttatttatagttttaaatagaatttcctataccaggtattccttgttcccaccggcttatcatcacctgaattgccttccttaattataagcccatcggcttatattgcccaaattggctttttactcatgggcatgcattgcctgtgagaacaatgtttttaagccccagacccatcccttaagagccactgcttgttagttatgagcagttgaactaaacctgcttcagcttggttgtgatgctacagacatggttcttaactagttatttacaaatcatgttctgaggactatcaggcccatgaataaaagagaagtaaatgtgaaatacggagttttagtcctcacttagagattcaccatacacagcagaggattgcaggccctcagaagtctcagaggtaaagagacatgtttaacaagatttaaagttgcttttcccaaacttatttggtgatgggatgctttttattgtaccatttattagtaggttttagaactagtatcccttggttggaagaagaaacagaaaaggaatactctcctgtattttatcctgcacactcccacactgagaagggtgaactcacaataactttgcagagcaggatggacggtggatgaatgcttatacttacatagggttgctgcatctggggccagtttatttatggggtttaaaatgagttcacacatcattagaaactcagggcagtttgcaggtgagaacactgagacctgcttttaaaaccttccttattgggagagagttcagtggatgccatataaagtcattctctctttcaagcctctttgaagtgtgaaaatcagcatctgccactactttacactaatttcatgtttgtgaaaaaggagatacaggctgttggttttgtgcaaataaatgaaaactgcccaaatgagaacaaacagtggttacttattcaaaggtaactataacaagggtggccattatcacttgtgtttggcaggctcaaaggcgggcaggggatgggaaacccccctttataggttagaaaaagagaatacttcaagcatgctctgattggaggttgttggcctagagaagctggacatggctaactagaagtggggcaccttaagtgattgtattagggaatacatttggccttccctggttggtcccaagttggaagcagaggtaaaaaatagggacgctgacagtcactgaccaagtcctgaccattctgagtcaattgctgcagagactgtgttttggttgcctaggctagcttctgcagaggttttacatcagaattctatcattatatatgatctggccattgtctatttgtatactgattttctcagcttataatgtggactttgatgcttgagaaaatatcaatctaattaaacctactgacccttggaaaatttagagtgagtgctatgcctgctctgggttacttctggagaatggcagtaatcatgcattctatttttattcaaatgctcacatagaatacactgagtcaggtaaaagcacacgttttatcacaactacgggatctggttagatggtcggctttttaatttcatggccgctcactgccactacagcagccgtcggcaagtctacaaggtctgttttgaattcgaaattgaaagtatggcaaaccaaacaggcctgatattgacattttggagcaagctgcttacctctctgcatgtcagtgatgtgctttgctttgccttctctctttattttcttagatatctattaaagcctttgcatttatccaagaatcataatatgtacatccaaactgtcaacccaaaaatctggtctgaagtgacgactcagtttcagttgagggaagaggcaatcctgccctcccacaatgggttaggccttttttgtgttgctataaagaaatacccaagactggataatttagaaagaaaagaggtttgtctcatggttctgcaggctttacaggaagcagggtgccagcatctgcttctgatgaggaactcaggaagcttacaatcatggcgggagaggaagggggagtatgcaactcacatggccagactagaagcaagactagaagcaacgtgtcacacacttttaaacaaccagatctcatatgagctcactcatcactaagaagatggcactaaaccattcatgaaggatacatccctgcaatccaatcacctctcaccaggccccacctccaacattagggattacatttcaacataagatttgaagggggcgtctgaggtatatcctctacccccaccagtaaaaatctacaagaatagtccccaaatcttgaatgaatgaaaacaaatggaaaagaggcatcaaataggaaatcaggaaagtatcaaatcatgggtcattttaatgtgtctcagagatttaggtttaatgaatatttaactttttttttttttctggtgacagttgaaatgaatagtcaggttgacaaggtaaatgacccaacagagagtcaacaagaagatcaactaataggtaagatgccccttgtggtgagattttcaatgatcaaccagccataagaactatttgcaaatgacatactggatttcccttggttttgccaagtccccacagcatggcttgggataaaccttgaaaatctttaaaccaaataacacagcgtaaggggaaacgatcacccctagaagcttgccatcttgaagaggaaaagatgagctacagcacattcaaatcatgtataccctggttttctgtgctttgacaagtaaaaaatgtctccatccatctcaccccctggcctcctggagtggtcaaattatttcagaaactccaagctgattctgaagcattgcttttctagaagctacctgctgagttgcttggtatatctgtctttaagcataacactcaatctttgccctggagtttgtataaaggaatatgagtgtgtttggacagaaacaagcctgccttaggtcctgtttttttcacaccactacctgtggacccgtgcgtctgcacaaaggtttgttatgttgaatgagcttcagggaactcccaggaaaataaaaagcctgggtttgttacgttgaatgagcttcagggaactcccaggaaaataaaaagcctggtccagatcatgtttaggagtttttccagaccaacattctaaatctctcagtagagactaaaatatatttagaatgatgagtgtaactgagtccaaagccagtactgcttgcttcatggcagccaatacatcaagagacaacgtgttgaggcaaggaaaatgactttattccaagagccagcaaaccaagaagatggcaaattaatgtcctaaagaatcaccctaaatttatagaattttaggctccttttctctttgaggaaaaggaacagagaggtggttgagatcaagaggtgacagacatctggactgcagcaagggttcaagggggagttgtgaaacgtctttgcccttggtcaggtcacattgctcctataaatctttaacataatgttgttacttgtgtgcatactgtctttatctcttcggtggttagttttgggaaggaactattgtcatctttgctttaaagttgaactataaagtaaattcctgccgtagttagctcaccctgcatgaagagatgagcaaaagcaatcaacctaaaagatatcactggacgggggcagcggggagcaaaatggagctagtcatgctaagcctcctttacactgctacctgagtggtctataatcctcttccataccctgagggctgatgagaagaattagaagaaggaaattatgcttgatgttataactgttccaagttctggtttaaaatatttagttgttaaaaaaaaaagaaaaaaacctatggaataaatgaatcatgggtcatctagtgtaaggcacaaataatgtgttgacacccttgccccctgtacctccttgcactcactgcatgttcttgatggttctctacactttcctaagaggcttggctttaccactcttgtgctccagcatcatggaagaataaaatatgggaatgtgtgaaagagtacatgtcttattcctgtatggtcttgaatatcctataaaactaaatgtaatggtatctgtgtaatgcatgtatagcataagactgctaaaaagtataagctcatacaaacatgttcttataaacatttctcctttttttttttactttctttatatatttaaaataccctgctaagctgcagaaatgatacggttgaggagtttccattaaaaagtaatgaaatgagactaaacttgaacaatttaaatgcaagctcctcagtgtttcctttccttttacccttttgctgccaataaactataggcttcttgtctagacttttttcttacagacattatttctttcctgtgtgaccagtgtccagatgaagtgccaggattagtctgtttttcttggttaatatcaaaatgatatttttcttgaaaataaaaatgaactcatatgttaacccaaatgaatcaggtgtcaaaactttttttttttttttttttttttgagacagagtctcactctgtcacccgggctacagtgtagtggcacgatcttggcttactgcaaacttcacctccctgtttcaagggattctcatgcctctgcctcctgagtagctgggattacagtcgcgtaccaccacaactggctaattttttgtatttttaatagagatagggtttcaccatgttggccaggctggtcttgaattcctgatctcaagtgatctacttgcctcggcctcccaaagtgctgggattaaaggccaggtatcaaaacttaaagtccaaaattagtttaaggaaactaaattccaggaaggagaagtgacatgcacagggtcacctggctaataaatggaaatttaaatactccaattcaaaattctgctccctaagcaatagcaagtttctggacacagttgtcacagaggcagaatgaatgatttgtgcaacgtcactgactcccacagcaatatttacacagaagggtttgttaagatgatctggtcgtttgacagaaagaaggaacccttgctccatgaatcataccttcaaggaaattaaagaaatacagtgaaatagaattagagagctcaaagacataatacaagaatgtttggcgttgtataatttgtaattgtaaaaaatcagggatagcataaggatacaacagggagagggttaaatgcatcagtggaacactttccaaatgtaaatgttttccaacaagtatttgagggcagtaatgatggttatggaatctgaacctttggttctggagaaacatggcagactgagtgtggcttctaggttgagctttaagaggcttgtaacttccgtttttgcactctcgtaatgctcgttgcctggaatccagacaccttggaagaagcccaggttatcctatagaatgaaggaggtcacatggagaaaagtcctagaaaatgagaatccctttcagatgttctggccccagcaggtaccaccctcaagcagatgaactgtcctgctcagtccaggccagatggtaaaatcatgagaaatagtgaatcactcatgttataagccactaaatttggggctttagattgttgatacagagacaggccttatggccacagtcttgcattttaatgcccaccttggaccttgaaccattcaacgtaaggagttggaactgatacctctgcataaataaatctaggacttctagctcaagaaattaatagaaagacttggatctgcgccaggtactgcatggggagagaaaaaggctcccaagatagatagaaaccgcaaatacactgtgagtttgaaacataattttatgtgatccaaagtcatgcagtaataaacaaattgaaaaatgaacttaataattgattacagaccagtgtgattcctggtgtatgtggcaaatggaaatatgaaactaccccatggaatttctgcaaaagaaaaacaaattctgaagttgaattcatagttttaagacttacagaacacacaaggaaatgatccattttgagtgagagtcagtaggtaaaattacaggacaattagcactatgagaacgttaagagagtaggaaattttgaagattttataaaataactacatttgaatgacaaaacaaataaaagcagacctaaaacaataagaaaagagcaacactaaataattaacgacaatagaaaaaacaaattaaaatgtagtagtatcaaagacacgtgaagagacatgaaggagaagaagagaataaccaagacatgttaagttcaataagagttctacaaggagactaggcagtgtagggctgtgtatttgattgatacccaccaagcatctccaggtttaacttaatttggactgagattactgaaaaccagggaccgcagatataaaatacagaaccacaaggaaatcccaccacgatcccactagtattgaattataaagttaacaccaccaaatgttacagaggatgtggaggagctagaactcttatacatggctgggggacatataaaatggttcagccacttttaaaaaattgttagtttcttgtaaagtatgtatccatcctatggccccacaattctgttcccgagtatttgagagaaatgaaaacctatattcacaaaagccttgtacaagaatacacatagcagatatgctcacaaaagccccaaacttgacacaacacaaatgtctcgcagcaagaaaatgaactttaaaaagtgacatatacatacatgggaattctagttagcaatgaagaggaacagattactgttaacaaagcagcaacatgaatgaatctcagaagcattacactgagtgaaaggagacagacacaatgaggtacttgtatgattccattagcagggagtcctagggcagaaaaaaactaatttatggagatagaaatcagatcatttgttcattccagcaggagtggggtagtagggaagggaactttccagggtgatgtcatgtatatcttcttggtggtgtgggtttaatgtatgcatttttcaaaacagattgaaatgtatgcttaagatctgtgtgttttcctgtaggcagattatacctcaattttaaaaatctaaaaaaaataaagagtataggtttttgcaaggcacagtgtcttcttagtgtcctctcatgggtagtgaataaggcagataatttaataagtacaatctgaagtggtggcataaccatcaatgacttttgcaaagcagcattatgaaaattgttattatttatatgctgatccctggaaactagagtgtgagcatgggcctgaaaagggaagccacatcaactcagggttacagttttcaacgaatactttgaagaattgagttaatcgtccccatcagccaaagctcgttgtcaatgtggcatacatttattaacagtgatttatatgctctttaaagataccatgtgccagcaattacagttcagacatctaaagctctttgatagtcaaataagatatttctgggcctatgtgaggggtgagagacatttaaatggctgtattaaaaatgtattccttgctaagcctgtgaagatgtcttatctttaatctaacaaatggcttctctttgtcttcagcaggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaagtttcctttaatttggtggagggacccatgttgacgcatctttcaggcattatccttgtaatttctgtcttttctcttacaactttgccccagggtcacagtggcttgattgaacactcacatgtgtatcctggcccctgtctgctttcttggttatttcacaaagctggtcacacagtggtttattcaaaggaaggggaggaagacagtggtttgataagctgcaggataaattttaggaatcaatgagcccagcagcagtataatccccagacagaggaggcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgtttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatacagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgtttgagaggataatgtgaa
